United States Patent 7,745,391 (HUMAN THROMBOSPONDIN POLYPEPTIDE) - sequence listing, part 81

SEQ ID NO: 283979 - DNA, 1847 bp, Homo sapiens
ttgtataaagcactctaatttttattttaatttaatgttggtctcaacccacaaaattgcttttataacccatgagtgaattgtgcctgcagtttggaaacactgccctggaaagggatctgcctgctcttctccagccccacttcccagaagaaaaaccaaaatgagagcccctgcgtcctggtgaaggtcagtggcgggcaggccaagcagggcctccagagctgctcgagggcctccaagggaggtgagctgcagagggacccaggagggtggaaggatgctggctggaagtcacagagggccaggttcaaatcctgcctccgcttttgattggctcccagaccttggatctatctgtgaattaacctttgagcctcggactcctcgtgcgttagcctgggtataatagtctctctctcgcagtgttgccgtatggattcagggtgatttaatgacctcaacagagctctggaacatttgcgtagctggcagggcaaggcgagggacagcccaacgaaggcaggtccttgaagtcctggttaacactggtttccaaaattcgagccggcctgcggtttttccagcacgcctgaaagctggggacactcatgcaccagtgttggaggctgtagcctttgaccaggcatgggaccaggaggtgaggccggctctcaggcatcaaccaaaggatccactgaatctcccttctccccctgccaacaaaggtacaagtagatgttgacaccccctcagacatggaaggagacccatttttttctttttctagttctggataaatggccttaaacaaaatatgcaaacaggctccttgcgtctcccaaaggcagcccaccacagaagccctgccacagcccaaggggttagatgctgccaggatctgtttccgccacagagcagctctgtgcagcacgttcctgccaaccaccctgagtgcttcagggcttccgaggccgtgacagtgagggcagcggcacttctgggtcaccgtgggacaggtctctgcctcaggacacggattgacaagctctctgagtgggccaggagctccttaatgtgagccaagcccagccctgccaccttggccccgttcacctcgaggatctcatcgcccacccccagcagccctgagtacagcttggccatgctcatgtcagccatctcctgcacgtagatccctgcagaggaaaacaggagaatttcacaatgacacccaaatcgaagaagtgcatctctggaatgctgaccatgttgatgaggtgctgtttgtgtggcacagggaggaggtgctcataccaggcacttctctgtgcgcatgcacacatacacacacccctcattattccatctcacaaccacaactggctttagacatagatacagtgcgcctcctccatggtctaactccattccactgtctctgcttttaaagtggaaatgctcctagtgcaaataacgcgttaaactgttgtcatttatttatacctgacagtgagtgagctaatctttttctgagatgagcttttcttgtagaattgggaggaaaatagtttttaaaaattaggaaccatacctactcagtgcctggcactatgatccagttgctgcctcaggtcacccaggcccagcgtaaaggccggggtggtgggaaggtatcatcggaagagcaaaagtggctgagccacatccaagcctggtttgctgcactctattgccaaagactgacactggcctcagtcttactcagatatggctcctcaattgggatggggaagcatctgagcaaaaaaccccaggaaaaataaaaattctagccacatatttca

SEQ ID NO: 283980 - DNA, 1923 bp, Homo sapiens
tgagagaagctttagctttgctttttagtaagttaagactgacacatggccatccactcccaaagagtcccagccctccaggcagcactgaggcccaggcagatggcccagccgcgctctgcagcttccctgctgcccacccacccacctgcccaccgacagcaccgccaggaggtctgggcagaaagcatgcagctgtgatggccaggcacctgccgcagccctgtctccaagctggacagaactaagatggaggctgccacaggtcaggttgcagcaactcttgcctccacctgggcagaggcagcggccggggtggcatggggctggtctggccggtcccactagctggatcctggctaccacagtagcacgtcctgaaattggtctttgttgttgttgttgttgttttcaactttatgtataaaaaaattttcctagaaatttttaatattctggctaccagataacatctcccagaattcccacaccccgaaggggcataaaactcctgccagaccacacgttctgattttggtttggcatatatggtcaatggctgtaaggctggtactccgggacactttgcccatttctggataaagggcaagggcagtgaatggagtagggaggaacgtggctgaaatagggaagggtcaaggccaatatggacatgtgctttctttggttccacagtgttggaggctgtagcctttgaccaggcatgggaccaggaggtgaggccggctctcaggcatcaaccaaaggatccactgaatctcccttctccccctgccaacaaaggtacaagtagatgttgacaccccctcagacatggaaggagacccatttttttctttttctagttctggataaatggccttaaacaaaatatgcaaacaggctccttgcgtctcccaaaggcagcccaccacagaagccctgccacagcccaaggggttagatgctgccaggatctgtttccgccacagagcagctctgtgcagcacgttcctgccaaccaccctgagtgcttcagggcttccgaggccgtgacagtgagggcagcggcacttctgggtcaccgtgggacaggtctctgcctcaggacacggattgacaagctctctgagtgggccaggagctccttaatgtgagccaagcccagccctgccaccttggccccgttcacctcgaggatctcatcgcccacccccagcagccctgagtacagcttggccatgctcatgtcagccatctcctgcacgtagatccctgcagaggaaaacaggagaatttcacaatgacacccaaatcgaagaagtgcatctctggaatgctgaccatgttgatgaggtgctgtttgtgtggcacagggaggaggtgctcataccaggcacttctctgtgcgcatgcacacatacacacacccctcattattccatctcacaaccacaactggctttagacatagatacagtgcgcctcctccatggtctaactccattccactgtctctgcttttaaagtggaaatgctcctagtgcaaataacgcgttaaactgttgtcatttatttatacctgacagtgagtgagctaatctttttctgagatgagcttttcttgtagaattgggaggaaaatagtttttaaaaattaggaaccatacctactcagtgcctggcactatgatccagttgctgcctcaggtcacccaggcccagcgtaaaggccggggtggtgggaaggtatcatcggaagagcaaaagtggctgagccacatccaagcctggtttgctgcactctattgccaaagactgacactggcctcagtcttactcagatatggctcctcaattgggatggggaagcatctgagcaaaaaaccccaggaaaaataaaaattctagccacatatttca

SEQ ID NO: 283981 - DNA, 1506 bp, Homo sapiens
acgcagagagacctgggaggggacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgtttta

SEQ ID NO: 283982 - DNA, 989 bp, Homo sapiens
acgcagagagacctgggaggggacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggatcaaactcttcattgaagtactcatcaggcgtgatggctgtggggttgtttgcagtagcacattccgtggtgaggtcctgctgagccagaactcaggagagtcagaaatgccaaatgatgttcacaagtgaaggcctgtggcactcagtgtctgaggtggacgtgttaaccagctaaagaccgggaagttctattcactaacttttttgcatggaacaagaaaatctatgaggatatcaccaaactacacaggaagtgtaatggatttcttcattttaaaatatttctctactctcctttacatttttatctcctgattataacaaagaaaaaaagaaagaaatatctgaaagtgcatgagacttggaagacttggagttgaagttctagctgtttccctgtctagctttgatagtggaaaggtaatttcatttttctgacccgcagggacatccactgtaccaagttcatatagttactgtgagcatcaagtaagaaaatatttgttaaggtgctctgttgcaatataaagtcctgaatcctttttaagttccatttctataaagaggcccctcgtttataatggataagagggaaagcacctgatttctataatcactacccctcctctaaaatccttatttattttcaaagagtcactcatctaattctcttccaaaagagtatctcaaattccagcttgggggtatctttggcctttacatagagtgggctgttcaggatccagtaaatgccatcccagacacagacaagttg

SEQ ID NO: 283983 - DNA, 1353 bp, Homo sapiens
agcgggaagatgctgcgtccagcgttaccgtacgcggtgctgcgagggcagaacctggtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgtttta

SEQ ID NO: 283984 - DNA, 2035 bp, Homo sapiens
acgcagagagacctgggaggggacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgttttactccagcctgggcaacaagagcaaaactccgtctcaggaaaacaaacaaacaaaaaaaaaaaaccacttcctgctgatattgggccactcaagcttagcttttcagtttttaaataatccatagtcattgcacctcttgacctgaaagagtaatggttttcttcatagtgtccttgtggcttcaaagtattgatatctactttcccctaaaagcaaagcagctcctttacatcttcccagaaatacagcctcatttctggaacccatacatttctactggccactgcctttgttgtttttaatacccgcttatttagatataggaagagtttggaagccttatcatctggacttctaggaacagcctcacaaagcagttggcttcaagggatagcattgatgcagagctttgatgttggctgggcttcccttaccccacaagagccagttcccctccaggaggaccacagaggtgtcagaacagcccaacactggcttgcttttagttgccatttgaaacaagcagcat

SEQ ID NO: 283985 - DNA, 681 bp, Homo sapiens
acgcagagagacctgggaggggacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggatcaaactcttcattgaagtactcatcaggcgtgatggctgtggggttgtttgcagtagcacattccgtggtgaggtcctgctgagccagaactcaggagagtcagaaatgccaaatgatgttcacaagtgaaggcctgtggcactcagtgtctgaggtggacgtgttaaccagctaaagaccgggaagttctattcactaacttttttgcatggaacaagaaaatctatgaggatatcaccaaactacacaggaagtgtaatggatttcttcattttaaaatatttctctactctcctttacatttttatctcctgattataacaaagaaaaaaagaaagaaatatctgaaagtgcatgagacttggaagacttggagttgaagttctagctgtttccctgtctagctttgatagtggaaaggtaatttcatttttctcttgttggagcttgggatcctctagatcacc

SEQ ID NO: 283986 - DNA, 457 bp, Homo sapiens
ctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgttttactccaccagttatttcccaagtgtttgaaatgcaggtgtgtgtctgaatttgatctaatcacttaaagaagctctgtgaagtgaaatttctttttttgagacggagtttggttcctgttgcccaggctagagtgcaatg

SEQ ID NO: 283987 - DNA, 1620 bp, Homo sapiens
acgcagagagacctgggaggggacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggagtccctgtcgcccaggctggagtgcaatggtgcgatctcggctcgctgcaacctccgcgtctggggttcaagcgattctcctgcctcagccccctgagtagctgggattacagtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgtttta

SEQ ID NO: 283988 - DNA, 654 bp, Homo sapiens
acgcagagagacctgggaggggacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggtgttgatgggaaccattttcagcatcctgctggtgactgtcatccttatggcattttgtgtctacaagcccattcggcgtcggtgacagccagacaagtttttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgtttta

SEQ ID NO: 283989 - DNA, 2237 bp, Homo sapiens
ggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctca

SEQ ID NO: 283990 - DNA, 2553 bp, Homo sapiens
ggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctcaaactgagttctgaaatttatttgattctgatctgaaactattgtcttcgtaaaagttagatctgacttcagacagaaaccaataccagcttccttttcctttaaactttgaagagtgttgatttgttactatattactatgcaaaactggcagttatttttataatataaatttataatttgattttttattttaaaaactgggttaatcaagtctcggtaagtcctttaaaccatttaggatttttaaaacatcaaaatttatgatttacattcataggaataaaataaaatattattagaactctgtaaatgtt

SEQ ID NO: 283991 - DNA, 2356 bp, Homo sapiens
ggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagccacagggaacaagattctccaaaggacaccgttcatgtcacggatatgggtaaccaagctccacagcagctgctggcagtggctcatggggtgggggagaacatctgcacagtttgtgggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctca

SEQ ID NO: 283992 - DNA, 2181 bp, Homo sapiens
ggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacggagtgaactactttatgtccaagggtatcctggatgattcgccaaaggaaatagcaaagtttattaaattggaaaaaactgagaatctatcttgatgaaaggagagatgtcttggatgaccttgtaacattgcataattttagaaatcatgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctca

SEQ ID NO: 283993 - DNA, 2500 bp, Homo sapiens
ggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggcaaggaaatcgaaagaacaggaaggattcattaatttggaaatgttgcctcctgagctaagctttaccatcttgtcctacctgaatgcaactgacctttgcttggcttcatgtgtttggcaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcatagacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctcaaactgagttctgaaatttatttgattctgatctgaaactattgtcttcgtaaaagttagatctgacttcagacagaaaccaataccagcttccttttcctttaaactttgaagagtgttgatttgttactatattactatgcaaaactggcagttatttttataatataaatttataatttgattttttattttaaaaactgggttaatcaagtctcggtaagtcctttaaaccatttaggatttttaaaacatcaaaatttatgatttacattcataggaataaaataaaatattattagaactctgtaaatgtt

SEQ ID NO: 283994 - DNA, 2114 bp, Homo sapiens
ggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctgcgagcaacatttctaacaccaatcatcgtaaacaagtccaaggaggcattgacatatatcatcttttgaaggaccttgcgaatgatgaacttctctggcaagggttgtgcaaatccacttggggtcactgttccatatacaataagaacccacctttaggattttcttttagaaaattgtatatgcagctggatgaaggcagcctcacctttaatgccaacccagatgagggagtgaactactttatgtccaagggtatcctggatgattcgccaaaggaaatagcaaagtttatcttctgtacaagaacactaaattggaaaaaactgagaatctatcttgatgaaaggagagatgtcttggatgaccttgtaacattgcataattttagaaatcagttcttgccaaatgcactgagagaattttttcgtcatatccatgcccctgaagagcgtggagagtatcttgaaactcttataacaaagttctcacatagattctgtgcttgcaaccctgatttaatgcgagaacttggccttagtcctgatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctca

SEQ ID NO: 283995 - DNA, 1407 bp, Homo sapiens
ggtcattcgtctccgcccggggtctctgtaaggacggcggagagaggcgacctccgcccaataccaggcgcagccttgccgtctcctcggggctcaccaagcagccaccagcaaagaagccggtttcaaaggcccagcacgacagggagaggaaaacggagcatatgcaaccatacacagtcaccagagtccagcctcccgcaaccagtcgctacagccaggcgcctgcgcccagaagcgcttctcgcgccgaccgtttgtatttggaattgtgggttcctgcccgccacgcaccaccgcaagaccttcaaagctgggagcttctctgtgctccaggattcctcgctgccgattccacaccgcgttcaagactcctgtgaagagcgactccgctgagagcctcctcaatggccagtccacttctaacttgcagctgagaagtttttctgatcttgatggtcagagtggctcgtgctacgaagtgagaaacaaggaatctatagcgaatcgtaaacaacagaaataaaaatgcgtctccgttaagagtcggagcctaacgtcacttccggcaacaataggaaacgtcaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccatgctgtctatgtactgtgctactctttgattctactttccattgacctcactagccctcatgtgaagaataaaatgtcaaaaagggaatttattcgaaatacccgtcgcgctgctcaaaatattagtgaagattttgtagggcatctttatgacaatatctaccttattggccatgtggctgcataaaaagcacaattgctaggacttcagtttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctca

SEQ ID NO: 283996 - DNA, 2193 bp, Homo sapiens
ttcttcattcttgttacttctatgccttctctatagtgcagtcttttgtctctttgatcctgatgaactgataatttactacttattacatttagattcccaatcctttattcatgtgtatcttgaatttcagcaagatatgaaaatgcagactccaggggtacattttgtaatgatacaagccttctgaggaaattttctgacaggagcttttaatcctgctgtggtctgttttaccctttccaatacggttttcctctgtgcttgcgaaaaatatcaaaaaagaccaattggcacattctgaatgtgttttctgaataagtatataagtagagagggaggccattttgcaaatgcggataatgctgacatgtcgtacttctaaataaattataatttgatttaaaaaggttgcctgcatgtacatttgccattttacaaagagcaaccgtactcctacctccacccaagttggtaacaaccttatcttacaaacaacccttaatattttaaaagctgcagaaaaaacaaatacatgaataaatgaataaacaaaaaacacatagggaaagggtatgagctcttgctgcaaggagtagatgaaagactgataaatgaagctgaggtccccccagtgcttccctttcaatagtttatgctaaaaatatttgttttttaaaactctgcgctttcttcatttttattggaacgcaatttgtgaaccacaactgagtctgtatgcaggatctccagaacgcaaatcagaaaaaaatttgagattttattcagatttttctattagattgagccactaatgttcggtaaggggcacttgatggttaaaaaacacaactggcatgataaaactacactaaataatatctactttatttgaacagtcatatcaagaatggccctaaatttaatcaaggactaaatttaatgaaagactctgacattaaagactctggattgtttgaaggtattttgcctgcaggtgagactggttttgagggcacagaaacgtagcctgaatgaaccattcagaactcatcatgcatccaactgaacacgtttcatgcttactcaatttttttttttttaaatgcaacaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaacgcttttaaagaaaatttgtgagttgtatattccaattcaaaatgccatctacattccccttatgtttcagtgtgagcaatgaagaggtcttttgatgaattaaatttcattaattaaaaaatacattcaaatattcaaaattaaaaagga

SEQ ID NO: 283997 - DNA, 1123 bp, Homo sapiens
tacaccatccccatgccaataacctccctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaacgcttttaaagaaaatttgtgagttgtatattccaattcaaaatgccatctacattccccttatgtttcagtgtgagcaatgaagaggtcttttgatgaattaaatttcattaattaaaaaatacattcaaatattcaaaattaaaaagga

SEQ ID NO: 283998 - DNA, 487 bp, Homo sapiens
tacaccatccccatgccaataacctccctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctca

SEQ ID NO: 283999 - DNA, 2109 bp, Homo sapiens
cggctgaggcgcctcgaagggcaagcgccaagggggcgcgggcgccgccggaggggggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaacgcttttaaagaaaatttgtgagttgtatattccaattcaaaatgccatctacattccccttatgtttcagtgtgagcaatgaagaggtcttttgatgaattaaatttcattaattaaaaaatacattcaaatattcaaaattaaaaagga

SEQ ID NO: 284000 - DNA, 2223 bp, Homo sapiens
cggctgaggcgcctcgaagggcaagcgccaagggggcgcgggcgccgccggaggggggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgagtgagtgagccggcgcggcgggggtcgcgccgaggggcggcgggagttggctcgccgcgacgggagcctcgcaacttttccgagggggctgggaccgtccgccgcgggacagagttcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaacgcttttaaagaaaatttgtgagttgtatattccaattcaaaatgccatctacattccccttatgtttcagtgtgagcaatgaagaggtcttttgatgaattaaatttcattaattaaaaaatacattcaaatattcaaaattaaaaagga

SEQ ID NO: 284001 - DNA, 1706 bp, Homo sapiens
cggctgaggcgcctcgaagggcaagcgccaagggggcgcgggcgccgccggaggggggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaacgcttttaaagaaaatttgtgagttgtatattccaattcaaaatgccatctacattccccttatgtttcagtgtgagcaatgaagaggtcttttgatgaattaaatttcattaattaaaaaatacattcaaatattcaaaattaaaaagga

SEQ ID NO: 284002 - DNA, 1365 bp, Homo sapiens
cggctgaggcgcctcgaagggcaagcgccaagggggcgcgggcgccgccggaggggggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcagccagctgccatgctgtgagctgcctcatggtgagatccatggggcaaggcatcagaggaggcctctgggaaacaactcatgaggaattgaggcctccagtccaacaaccgtgaggagttgaatcctgccaggaacaatttgagtgatcttagaagaggatccatccccagttgagccttaagatgatctgagttcctgctgacacctggactgcattttggtatctcagttccttttgcaagagacccagagccagaggatttagcaagttgcacctgaatggactgttgatgagtcttgaaaagatgagataataaatgagaaattatgtcaaa

SEQ ID NO: 284003 - DNA, 1473 bp, Homo sapiens
cggctgaggcgcctcgaagggcaagcgccaagggggcgcgggcgccgccggaggggggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctca

SEQ ID NO: 284004 - DNA, 1987 bp, Homo sapiens
cggctgaggcgcctcgaagggcaagcgccaagggggcgcgggcgccgccggaggggggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaacgcttttaaagaaaatttgtgagttgtatattccaattcaaaatgccatctacattccccttatgtttcagtgtgagcaatgaagaggtcttttgatgaattaaatttcattaattaaaaaatacattcaaatattcaaaattaaaaagga

SEQ ID NO: 284005 - DNA, 1789 bp, Homo sapiens
cggctgaggcgcctcgaagggcaagcgccaagggggcgcgggcgccgccggaggggggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaacgcttttaaagaaaatttgtgagttgtatattccaattcaaaatgccatctacattccccttatgtttcagtgtgagcaatgaagaggtcttttgatgaattaaatttcattaattaaaaaatacattcaaatattcaaaattaaaaagga

SEQ ID NO: 284006 - DNA, 399 bp, Homo sapiens
tccaggcaccaatgtgtttattttgatagtgaccacctccctgttctggtcgttgcagttcctggactattgtaggggttgctgccctcatcctgttcctggtagcactgctggctcgtgtcctcgtcaaaagaaaaccaccccgggacccactgttctatggtacgtctccacaaagggaaatcttttgtatctgattaataacacaatactttcagcctcagtcacatattcctccttggttgtgaatactctgagccctttggtaacagtggctgcaagtgtaggggtgtttcaggacaatctggccctcgcctctggctattgcctctcaggcagtggactccaccctctcccaggtggcatcccggtggagagttactgccaggccaggcaggg

SEQ ID NO: 284007 - DNA, 397 bp, Homo sapiens
gtgtggcttctgggcaggctccgacctctgcgtgcccttggtctggaagccagcccgggagcaagcggaaaagccgtggaaacacacccggattgaaatgcccctggcccgcctgacccgaccctaggagaagcagccgagttacccgacatcgtggtcagcaggagctgggtcggtggctggatgctgcagcagcagggactcagcgcctgggagggctcctggggcagggagagaagcagagatgcaacatttttaaaatttcacaaagcatccggctgcacccaggtccctggaacaggagacaaacagaattaatgttttataccttcgggtataggtttgagttttttccccctcatgccaagtatttaaaacctctagaaacccaaaaatt

SEQ ID NO: 284008 - DNA, 441 bp, Homo sapiens
gcgtttctccgaggcgcactgaggctccggggcgagtccgcgcagcgcgagctggggaaagccgtccggggctcccgatgaccctgcactccgccgggaggccgcccttcggaaaagccgtggaaacacacccggattgaaatgcccctggcccgcctgacccgaccctaggagaagcagccgagttacccgacatcgtggtcagcaggagctgggtcggtggctggatgctgcagcagcagggactcagcgcctgggagggctcctggggcagggagagaagcagagatgcaacatttttaaaatttcacaaagcatccggctgcacccaggtccctggaacaggagacaaacagaattaatgttttataccttcgggtataggtttgagttttttccccctcatgccaagtatttaaaacctctagaaacccaaaaatt

SEQ ID NO: 284009 - DNA, 3632 bp, Homo sapiens
gatgcacagatttatttaaactttagttctaaatatataggactttaaaaaatattttctgaaagtgatatccatttttgaggtgcaagcagttgggtccattttggagattccgccttaagccattcagcttcaaaatggcggggagctcttgctacagagggttaccccgttctgcttccttcccattctgttaaaccttgtacatgctccttcccacagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 284010 - DNA, 4462 bp, Homo sapiens
gccttaggtgtctctttaaaccctctctcccctctttatttccaaatctttatctttggctttcttaagctgtaaaggcacactggcaccttaggtggtcaggtaagatcgctggattccttatttcggcgaaagtccagcggaccattcccgccactgtacccattttagaaacacttggaagacccttaaggatcatttacggagagaaaggtcctgcgtgttccgaagttcaggggccccctgatcccgctgagccccctccaggagcgaaagggttaagaatgataaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgccgccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 284011 - DNA, 4563 bp, Homo sapiens
gagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtggtcctgcgtgttccgaagttcaggggccccctgatcccgctgagccccctccaggagcgaaagggttaagaatgataaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgccgccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 284012 - DNA, 4433 bp, Homo sapiens
ccgggccgccggtgggtggtcgctagggctgggccagcctcttggaggtccacgcccgccgagcccacgctggctggggccggggtgccggcgcgctcgggactcgtctcagcagtcgctcacggtctttgtgtcttctcttccgcccctttccctgcctgccgcctccggccgccacgatgcccctgcgccccgctgctgccgccgcggactggctgcgccggctgcgcgctgcttgctgcggcggtggtggcgccccatctgctacacgggcctgaagaaggaagaagaggaagcgaagcgcgccccccggcccatgccgcagccacgggcccagacccgccctcgccggagcccacgagacctgcatggacgggcatgggcttgagagcagcaccttccagcgccgccgctgccgccgccgaggttgagcagcgccgccgccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 284013 - DNA, 2308 bp, Homo sapiens
gagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtggtgagttgtttattttgttgaagtttgcggtgggcccgggggacgtggggggcgagcggcaggcagcggccgggactgttttgtttaggtctccatccacctgtgtggtataaatctgccagcctcaaggcggcgggggaccggagtgagaaagctctgacgctcccaaaagccccttttcgcaacttacagatctaggaccacatttgattctccacgcctggaaccggctagatcctagtttacgctcaccccgccctccagcctcccatcaacgcttcccgcacccgctgtgtgcagggctggcgctccgcagagcaaacagcgcccacgacccagggacagctggccaccgaagtccctccccggcgcccttccccgttccttgaggataggggagctgaggttttcatgtgaagggcgcccatgaaattcgtgggaacttgttctggcgtcttctggagtggagttctttcaggggtttcgggtctgcccgggactacaaaatgggatcctgggttggctggagtttcccagactaggctggagagaggtcggctgttggctcgcgggagagcccagaggaaccccttgggcgatggcagtcaagaccggcggctgcgtttgcctggaagaaaagcctaaatacattagcgagctggtaaagcttttaaggccttcttgggagcgagtggctggctaatgagaggttaattttgtttcgaagggaaggctgcactggtttcctgagataaatggacaggaagcgcattacctccgcgcgctggcaagcggctcccaaatgctttttgcacctgccgttttgagcggtgagagcagcggcggagcccgcagggattgcgggggcccgttgtctacgagcgggtgatgagccccccgcaagccccgggctctctccctccgcgagtgcattgctcacgccaagctttgggactcttctctcacacccaggtcctgcgtgttccgaagttcaggggccccctgatcccgctgagccccctccaggagcgaaagggttaagaatgataaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgccgccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataaggttatgtcatggctccctgacggtgaaatatgtgtgaaatccaaccaacacccagcaggatacactaacaaacattctacaaagccagaatggatgccctcaccctccttggaatgatgttaaaccaattgagtaaactggtcctgccaactgcaatgtaataaagtaggcctatcaaacttc

SEQ ID NO: 284014 - DNA, 1738 bp, Homo sapiens
gagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtggtgagttgtttattttgttgaagtttgcggtgggcccgggggacgtggggggcgagcggcaggcagcggccgggactgttttgtttaggtctccatccacctgtgtggtataaatctgccagcctcaaggcggcgggggaccggagtgagaaagctctgacgctcccaaaagccccttttcgcaacttacagatctaggaccacatttgattctccacgcctggaaccggctagatcctagtttacgctcaccccgccctccagcctcccatcaacgcttcccgcacccgctgtgtgcagggctggcgctccgcagagcaaacagcgcccacgacccagggacagctggccaccgaagtccctccccggcgcccttccccgttccttgaggataggggagctgaggttttcatgtgaagggcgcccatgaaattcgtgggaacttgttctggcgtcttctggagtggagttctttcaggggtttcgggtctgcccgggactacaaaatgggatcctgggttggctggagtttcccagactaggctggagagaggtcggctgttggctcgcgggagagcccagaggaaccccttgggcgatggcagtcaagaccggcggctgcgtttgcctggaagaaaagcctaaatacattagcgagctggtaaagcttttaaggccttcttgggagcgagtggctggctaatgagaggttaattttgtttcgaagggaaggctgcactggtttcctgagataaatggacaggaagcgcattacctccgcgcgctggcaagcggctcccaaatgctttttgcacctgccgttttgagcggtgagagcagcggcggagcccgcagggattgcgggggcccgttgtctacgagcgggtgatgagccccccgcaagccccgggctctctccctccgcgagtgcattgctcacgccaagctttgggactcttctctcacacccaggtcctgcgtgttccgaagttcaggggccccctgatcccgctgagccccctccaggagcgaaagggttaagaatgatgtaagtacaggcacttgatttctcaagtcgcccgcttggccctcttccaagttgtactttccttattttctctcctttcctttccttactgttctaacgctttttaataaactttcactcttgctctgaaaaaaaaaatgatgtaagtacaaaccacgagctgcttgacgctgagctgttggactccgggctatttcagccgctgctttgggtacacagtggccggggagcagccggggagcccttactctagaaaggattgcacaaatcgcaagcttaggtgatctgttaagcagtcagagattctcctgttagatttctggaaatggagacatattaactggagaacagttaaaaacatcacgtataggctcag

SEQ ID NO: 284015 - DNA, 5535 bp, Homo sapiens
gagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtggtgagttgtttattttgttgaagtttgcggtgggcccgggggacgtggggggcgagcggcaggcagcggccgggactgttttgtttaggtctccatccacctgtgtggtataaatctgccagcctcaaggcggcgggggaccggagtgagaaagctctgacgctcccaaaagccccttttcgcaacttacagatctaggaccacatttgattctccacgcctggaaccggctagatcctagtttacgctcaccccgccctccagcctcccatcaacgcttcccgcacccgctgtgtgcagggctggcgctccgcagagcaaacagcgcccacgacccagggacagctggccaccgaagtccctccccggcgcccttccccgttccttgaggataggggagctgaggttttcatgtgaagggcgcccatgaaattcgtgggaacttgttctggcgtcttctggagtggagttctttcaggggtttcgggtctgcccgggactacaaaatgggatcctgggttggctggagtttcccagactaggctggagagaggtcggctgttggctcgcgggagagcccagaggaaccccttgggcgatggcagtcaagaccggcggctgcgtttgcctggaagaaaagcctaaatacattagcgagctggtaaagcttttaaggccttcttgggagcgagtggctggctaatgagaggttaattttgtttcgaagggaaggctgcactggtttcctgagataaatggacaggaagcgcattacctccgcgcgctggcaagcggctcccaaatgctttttgcacctgccgttttgagcggtgagagcagcggcggagcccgcagggattgcgggggcccgttgtctacgagcgggtgatgagccccccgcaagccccgggctctctccctccgcgagtgcattgctcacgccaagctttgggactcttctctcacacccaggtcctgcgtgttccgaagttcaggggccccctgatcccgctgagccccctccaggagcgaaagggttaagaatgataaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgccgccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 284016 - DNA, 4453 bp, Homo sapiens
ccgggccgccggtgggtggtcgctagggctgggccagcctcttggaggtccacgcccgccgagcccacgctggctggggccggggtgccggcgcgctcgggactcgtctcagcagtcgctcacggtctttgtgtcttctcttccgcccctttccctgcctgccgcctccggccgccacgatgcccctgcgccccgctgctgccgccgcggactggctgcgccggctgcgcgctgcttgctgcggcggtggtggcgccccatctgctacacgggcctgaagaaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgccgccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 284017 - DNA, 2308 bp, Homo sapiens
  misc_feature (294)..(294): n is a, c, g, or t
  misc_feature (303)..(303): n is a, c, g, or t
ctgtcgtcgttgcccgtgttgccaaggtcgtctcctgatggtgtcggttcgaatgtcaaagcgcataggtctatggaaacgcatctaaatatagcacactgttgctttcccagattcgggttgccaattactagggctctccatgcttacccatcgacttcctactatgggtcttctgatttagactactactactggccgatacattaagggtatgcagaccagtacaggatgtggatactctcctcactcaccgctcacccatggtgtctacgcagtactggcaatggtggncgtgggagntccgtcttactgatggctatttgatacaaactcctaccatgatgcactcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 284018 - DNA, 2110 bp, Homo sapiens
gagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtggtgagttgtttattttgttgaagtttgcggtgggcccgggggacgtggggggcgagcggcaggcagcggccgggactgttttgtttaggtctccatccacctgtgtggtataaatctgccagcctcaaggcggcgggggaccggagtgagaaagctctgacgctcccaaaagccccttttcgcaacttacagatctaggaccacatttgattctccacgcctggaaccggctagatcctagtttacgctcaccccgccctccagcctcccatcaacgcttcccgcacccgctgtgtgcagggctggcgctccgcagagcaaacagcgcccacgacccagggacagctggccaccgaagtccctccccggcgcccttccccgttccttgaggataggggagctgaggttttcatgtgaagggcgcccatgaaattcgtgggaacttgttctggcgtcttctggagtggagttctttcaggggtttcgggtctgcccgggactacaaaatgggatcctgggttggctggagtttcccagactaggctggagagaggtcggctgttggctcgcgggagagcccagaggaaccccttgggcgatggcagtcaagaccggcggctgcgtttgcctggaagaaaagcctaaatacattagcgagctggtaaagcttttaaggccttcttgggagcgagtggctggctaatgagaggttaattttgtttcgaagggaaggctgcactggtttcctgagataaatggacaggaagcgcattacctccgcgcgctggcaagcggctcccaaatgctttttgcacctgccgttttgagcggtgagagcagcggcggagcccgcagggattgcgggggcccgttgtctacgagcgggtgatgagccccccgcaagccccgggctctctccctccgcgagtgcattgctcacgccaagctttgggactcttctctcacacccaggtcctgcgtgttccgaagttcaggggccccctgatcccgctgagccccctccaggagcgaaagggttaagaatgataaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgccgccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggatccagtgctactgctacaaataaggcaagtataccttcttttttccctctccctactcagctttcaaaagatgtttgattcttcagataacttttgaaatgtgctataaagggcctagtttaaaaggaacttcttttgaaaagcaattaacagttgataaaggattaaataaaaattatctagtaaggaatt

SEQ ID NO: 284019 - DNA, 873 bp, Homo sapiens
caggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaggacgaccgatgggcggccgct

SEQ ID NO: 284020 - DNA, 2447 bp, Homo sapiens
caggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaaaacagttggccctctgtatcc

SEQ ID NO: 284021 - DNA, 868 bp, Homo sapiens
gtaaatgttaatgctttccttatacgtgaaatgacataaaatcttggaatattaatagatgggaagaagatgtgtaataaaactgtctataaacacaattctgacaaatttcagaactgggactcatagggcttgtattcagttagattacatgctttacaacagagatactgttttatttgtgtcacctacaacatataatctgttgattgaggtatgttgaatagatgaatggcaaagaaagcagacctataaaatatcacatagtaagatatttatatttagatttttcttatttagaatcttcatctgtaatgtatgattttgaaaattaattcttggaacaacatgttgcagagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaaaacagttggccctctgtatcc

SEQ ID NO: 284022 - DNA, 1787 bp, Homo sapiens
tagtgaggccgcgcgtgtttatggcagagggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaaaacagttggccctctgtatcc

SEQ ID NO: 284023 - DNA, 824 bp, Homo sapiens
gcggaaacgggttttgccagttatgcgaaaacatggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttg

SEQ ID NO: 284024 - DNA, 1189 bp, Homo sapiens
gcggaaacgggttttgccagttatgcgaaaacatggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaaggtgatggtaactgccacagcaaaggcaataccgtagtttttgaatttgaataatagttttacctctgttgttaataggctatgaagaggatgtgggtattgctgttaataaacggaggactttgattc

SEQ ID NO: 284025 - DNA, 1264 bp, Homo sapiens
gcggaaacgggttttgccagttatgcgaaaacatggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaaaaaaaaaaaaaaaaaaaaaaaaattaaaaaaaaaaaaaaaaaaaaaaaaaaaaaaaaaaaaaaagaaaaaaaaaaaaagaaaaaaaaaaaaaaaacaaaaaaagaaaaaaaaagaaaaaaaaaagcgccaaaaaaaaaaaagaaaaaaaagaaaaaaaaggggggggcacgcgccaaaaaaaaccacccggagaggccccaccagcaccaccccaccacacgataaaacaaaggcacacgaagaggagaggagagagtacaaccagacgagcgagagagagggagcgaaacaacaacagcagggcgagcaggaagaacaaaccacagcaatcaagacaccgagggaagcaacaccaacaagcgggcgacaaccaaaagaggcagagaacaagg

SEQ ID NO: 284026 - DNA, 1043 bp, Homo sapiens
gcggaaacgggttttgccagttatgcgaaaacatggctgcggccggtttggcccttctttgtaggagagtttcatccgccctgaaatcttcccgatcgttaataactcctcaggtccctgcctgcacagggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaaggtgatggtaactgccacagcaaaggcaataccgtagtttttgaatttgaataatagttttacctctgttgttaataggctatgaagaggatgtgggtattgctgttaataaacggaggactttgattc

SEQ ID NO: 284027 - DNA, 1041 bp, Homo sapiens
  misc_feature (968)..(968): n is a, c, g, or t
  misc_feature (994)..(994): n is a, c, g, or t
  misc_feature (1014)..(1014): n is a, c, g, or t
gcggaaacgggttttgccagttatgcgaaaacatggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagcaattgcatatggcaaggccaaggtgccttagctggaccaggaggtgcccactacagaggaggatgacgccaccagccagcgccagcagccaggagaggagccagagcccttgtgccaggcggatgcggggctgcaggggcagcaccaggggcaacaccggcgccatctcccatctctgcccaagggagtgcagaggtgtcagggatggaagctggctggggcaggatgctgagtcagcccggcccggcttgagctgggctaatgccaccctgaccccaataccctgagcattctcccatcctcagncctaataacccgcccccctgtcagcnccaatacaagatgccttggncttgccatatgcaagggtaccgagctc

SEQ ID NO: 284028 - DNA, 811 bp, Homo sapiens
atagatcgagctcgtacctgcatatggcaaggccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaaggtgatggtaactgccacagcaaaggcaataccgtagtttttgaatttgaataatagttttacctctgttgttaataggctatgaagaggatgtgggtattgctgttaataaacggaggactttgattc

SEQ ID NO: 284029 - DNA, 678 bp, Homo sapiens
gcggaaacgggttttgccagttatgcgaaaacatggctgcggccggtttggcccttctttgtaggagagtttcatccgccctgaaatcttcccgatcgttaataactcctcaggtccctgcctgcacagggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttg

SEQ ID NO: 284030 - DNA, 1179 bp, Homo sapiens
  misc_feature (1)..(1): n is a, c, g, or t
ncgattctataggatccccgctatggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaaggtgatggtaactgccacagcaaaggcaataccgtagtttttgaatttgaataatagttttacctctgttgttaataggctatgaagaggatgtgggtattgctgttaataaacggaggactttgattc

SEQ ID NO: 284031 - DNA, 979 bp, Homo sapiens
  misc_feature (1)..(1): n is a, c, g, or t
ncgattctataggatccccgctatggctgcggccggtttggcccttctttgtaggagagtttcatccgccctgaaatcttcccgatcgttaataactcctcaggtccctgcctgcacagggagcagcatggacctgtcagcaactaaggaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaaggtgatggtaactgccacagcaaaggcaataccgtagtttttgaatttgaataatagttttacctctgttgttaataggctatgaagaggatgtgggtattgctgttaataaacggaggactttgattc

SEQ ID NO: 284032 - DNA, 832 bp, Homo sapiens
atctcctagaggatcccctgtattgcaaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagactggaacgtgagaaacgagcccgcatcaaagcacggaaggaaaatttagagagaaagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaaggtgatggtaactgccacagcaaaggcaataccgtagtttttgaatttgaataatagttttacctctgttgttaataggctatgaagaggatgtgggtattgctgttaataaacggaggactttgattc

SEQ ID NO: 284033 - DNA, 544 bp, Homo sapiens
  misc_feature (1)..(1): n is a, c, g, or t
ncgattctataggatccccgctatggctgcggccggtttggcccttctttgtaggagagtttcatccgccctgaaatcttcccgatcgttaataactcctcaggtccctgcctgcacagggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattctttgccttgccttatgtggaccattttctcagaggtaagcatcagaagcacatgggagcttttccaaaaca

SEQ ID NO: 284034 - DNA, 4234 bp, Homo sapiens
tcccggggggccaggggcgggggccctggaaggagcgggagttcaagccgagcagggacggggctaggggtcggggggtgggggcagaaagctgaagctgacacccgtgcatccggacaccgcacgagcatcgcctgtgacagcgccccgggtccggtggagggcagcggggggaggagggaaggaggaggagaaggaggaggaggcgggagcagcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccagtgtgtacttcgagatgtggtaccccttggtgggcagggtgggggagggcccagcccctccccaggtggagagccgccccctgagccttttgccaacagtgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcaggcccagctgttgagggttttcttgatgaatgaatggggtaccatacatggttaagataaagccttgggctccggactttatctgaggtgtctggagaagttctcctgcccctccacttttttgcatctactctcactaaatgagtataatgtcaagccccaactttctaaaattataggaataaatggtagcagatacatccttctaacttgttatggaggactataaatgaagttactaaaaacaatagactgaaatttttagtttaaaatatgcaagcctgaacaaggggaccaacattcccaagaaactggaacccagtcagacatatgatcaactgcttaatgtgtatgccatgtatgtcatgtgtcattcctttcccccaccccctccctagtggaagtgcttgcctactcccctaggacaggtaagtcctcggaaagtctaatcctcaatcttttgggcacaagttttataagggccaaccaagcatggagtcagggaaaaataggatcgagggccacaaaaaaagatggaagtggtaaaatagaagaaaaca

SEQ ID NO: 284035 - DNA, 3996 bp, Homo sapiens
ggaggaggatggggcctagagccgagtgaattccaaggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccagtgtgtacttcgagatgtggtaccccttggtgggcagggtgggggagggcccagcccctccccaggtggagagccgccccctgagccttttgccaacagtgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcaggcccagctgttgagggttttcttgatgaatgaatggggtaccatacatggttaagataaagccttgggctccggactttatctgaggtgtctggagaagttctcctgcccctccacttttttgcatctactctcactaaatgagtataatgtcaagccccaactttctaaaattataggaataaatggtagcagatacatccttctaacttgttatggaggactataaatgaagttactaaaaacaatagactgaaatttttagtttaaaatatgcaagcctgaacaaggggaccaacattcccaagaaactggaacccagtcagacatatgatcaactgcttaatgtgtatgccatgtatgtcatgtgtcattcctttcccccaccccctccctagtggaagtgcttgcctactcccctaggacaggtaagtcctcggaaagtctaatcctcaatcttttgggcacaagttttataagggccaaccaagcatggagtcagggaaaaataggatcgagggccacaaaaaaagatggaagtggtaaaatagaagaaaaca

SEQ ID NO: 284036 - DNA, 3240 bp, Homo sapiens
tcttgatggcgagtgctgtcgccgactcgcttctcgctgctctcgtgcgcttgttgttggcagcgcctcctcgtgggctctggctcgccatcttgaatctcgtctgctagtttcggatgtgtttgtggttgagtcacatcctgtcgttgcgtgtgtctgcgtgtggcgcggagtggcttgagcgtttcttcgtctctcgttgttcggtttggtcatcttttcgattcggttctgcgtcttgtgctgcgtcgcctcggcttcacttcggctctgctgtttggtggtcttgtgttcgtttgctgctgttgtttgttttttgttttctgttgtagtgttgtgttcttggtgttgttttgtttcatcttttgtatgttttgtgtgtcgtttcttgtgtttcttgtttttttgtttttctgtatgtttgtgttgtttttttcaccactcgctggggcacaccccacgctgtttttcagttttcacccacaaggacaaaagaggctctccgacgcgcgccctctctcttgtagatatttttgtttggaaaatattcctcgagcactctagcacgagaactctaacttctggaaaaatgtgagtttgaataaagtgtgtccacacctctctctaacaactctttccactctgacgccccaccacggagaaaatttcactctgaggcgcctcataaaaaaaataaccccccataaaaaaataaaaaaaaaccaaggggagaagcttataaaactaaatatggatctcagcatcaacagctgaacagagaaaggaattaaaacgctttaattaaaaaatcacgagtggatgataaagtgtgtagaaactgaaaatttacaactatttaaaacctggcggacgcgtgggtcgacccacgcgtcggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcaggcccagctgttgagggttttcttgatgaatgaatggggtaccatacatggttaagataaagccttgggctccggactttatctgaggtgtctggagaagttctcctgcccctccacttttttgcatctactctcactaaatgagtataatgtcaagccccaactttctaaaattataggaataaatggtagcagatacatccttctaacttgttatggaggactataaatgaagttactaaaaacaatagactgaaatttttagtttaaaatatgcaagcctgaacaaggggaccaacattcccaagaaactggaacccagtcagacatatgatcaactgcttaatgtgtatgccatgtatgtcatgtgtcattcctttcccccaccccctccctagtggaagtgcttgcctactcccctaggacaggtaagtcctcggaaagtctaatcctcaatcttttgggcacaagttttataagggccaaccaagcatggagtcagggaaaaataggatcgagggccacaaaaaaagatggaagtggtaaaatagaagaaaaca

SEQ ID NO: 284037 - DNA, 3049 bp, Homo sapiens
tcccggggggccaggggcgggggccctggaaggagcgggagttcaagccgagcagggacggggctaggggtcggggggtgggggcagaaagctgaagctgacacccgtgcatccggacaccgcacgagcatcgcctgtgacagcgccccgggtccggtggagggcagcggggggaggagggaaggaggaggagaaggaggaggaggcgggagcagcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccagtgtgtacttcgagatgtggtaccccttggtgggcagggtgggggagggcccagcccctccccaggtggagagccgccccctgagccttttgccaacagtgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacat

SEQ ID NO: 284038 - DNA, 304 bp, Homo sapiens
agactccgtctcaaacaaacaaacaaaaaaacctgaaaggcagagttgctgcagagttagatgaggtgtgtggaggggtgtggaccccagctgactacactctttaccagcatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtgagaactaggctgaaaactgagaagagtgggtg

SEQ ID NO: 284039 - DNA, 466 bp, Homo sapiens
aaagctgaagcaccccaacatcatcactttcaagtgaggtccagggcaggggctgggtgttggggatactatgctaaggcctggtaccctcctgggcagtgggacctaccccatccttccccagaggagatccataggtggaatgggtgggaatgggggttccaggtatgaatcaggtgaatgctgagccagctgaggccttcataccattgtttggctcccaggggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaagtgagtaagcaagcagggagcaacagatgtgcatgcaggtgacccactca

SEQ ID NO: 284040 - DNA, 397 bp, Homo sapiens
gaggctgggaaatgggttgagtgggactgaagagattggctcttagagggctgagtcaatccactcctttttgctccagcacacacattggcagtggtgtgggcaacctgcagagcctttcactgggtgaagggatggctctcactcttcatctgctctcaacccataggcagagtggcgggaagaagtaaaactgcactttgaaaagattaagtcagaagggacctgtctgcaccgcctagaagaggaactggtgatgaggaggagggaggagctcaggtgagttcccgtgcttggggaggtgattttactaacagcaaggactatgcacccagtcagctcctacccagccccagggcgggtggaaggactacgaaaggactgtggacaggaattc

SEQ ID NO: 284041 - DNA, 526 bp, Homo sapiens
tgagccgagattgtgctactgcactccagcctgggcgagagtgagactctgtcttaaaaaacaaatcagtaagccactggctattaaaatgaccccagcaaagaaccccaaggaatctcactccatttctactctttctcacagggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaa

SEQ ID NO: 284042 - DNA, 4135 bp, Homo sapiens
tcccggggggccaggggcgggggccctggaaggagcgggagttcaagccgagcagggacggggctaggggtcggggggtgggggcagaaagctgaagctgacacccgtgcatccggacaccgcacgagcatcgcctgtgacagcgccccgggtccggtggagggcagcggggggaggagggaaggaggaggagaaggaggaggaggcgggagcagcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccatgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcaggcccagctgttgagggttttcttgatgaatgaatggggtaccatacatggttaagataaagccttgggctccggactttatctgaggtgtctggagaagttctcctgcccctccacttttttgcatctactctcactaaatgagtataatgtcaagccccaactttctaaaattataggaataaatggtagcagatacatccttctaacttgttatggaggactataaatgaagttactaaaaacaatagactgaaatttttagtttaaaatatgcaagcctgaacaaggggaccaacattcccaagaaactggaacccagtcagacatatgatcaactgcttaatgtgtatgccatgtatgtcatgtgtcattcctttcccccaccccctccctagtggaagtgcttgcctactcccctaggacaggtaagtcctcggaaagtctaatcctcaatcttttgggcacaagttttataagggccaaccaagcatggagtcagggaaaaataggatcgagggccacaaaaaaagatggaagtggtaaaatagaagaaaaca

SEQ ID NO: 284043 - DNA, 4924 bp, Homo sapiens
tcccggggggccaggggcgggggccctggaaggagcgggagttcaagccgagcagggacggggctaggggtcggggggtgggggcagaaagctgaagctgacacccgtgcatccggacaccgcacgagcatcgcctgtgacagcgccccgggtccggtggagggcagcggggggaggagggaaggaggaggagaaggaggaggaggcgggagcagcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccagtgtgtacttcgagatgtggtaccccttggtgggcagggtgggggagggcccagcccctccccaggtggagagccgccccctgagccttttgccaacagtgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggtaaggatggtctgggctgggatactgggcctggagaagttgagaagcacggtagtactgggctggactgaccaataaatggcaggggtacatttaattcaaagagactgactttcatctgaatcaggctcatgctaccttctgagctgagtcaccaggggtaattggtatctactctgaacctgtttcctcatctataaaatacacttaacgatatctgcattcctgatttgtcatgaagtgccagtgagtgcatacaagtacaaggaaggagcagcataaccaccaagcatggttggttgagcctcaagtaaacaaccttagaacacagaaggaaaggaccccagaccctcatttggaacctagacccagggaagtttgacgattgctaatctgtcactgagcatttcccaaaatgtggttccttcaatgaagttattcagaaaaggcttttattttgggagacaagttggaaaatatggggttcaataggtttccttactgcaggattttgacacactaatgaatagtgtgtaatattctctagagacagttgaccataagttcttttgtcacagagtacattctaggattggattctccaggacacactttgggaaaggatgctccagttcctatctgatcctccctcaaattctcccctctccttcctaactccattcctttcaggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcaggcccagctgttgagggttttcttgatgaatgaatggggtaccatacatggttaagataaagccttgggctccggactttatctgaggtgtctggagaagttctcctgcccctccacttttttgcatctactctcactaaatgagtataatgtcaagccccaactttctaaaattataggaataaatggtagcagatacatccttctaacttgttatggaggactataaatgaagttactaaaaacaatagactgaaatttttagtttaaaatatgcaagcctgaacaaggggaccaacattcccaagaaactggaacccagtcagacatatgatcaactgcttaatgtgtatgccatgtatgtcatgtgtcattcctttcccccaccccctccctagtggaagtgcttgcctactcccctaggacaggtaagtcctcggaaagtctaatcctcaatcttttgggcacaagttttataagggccaaccaagcatggagtcagggaaaaataggatcgagggccacaaaaaaagatggaagtggtaaaatagaagaaaaca

SEQ ID NO: 284044 - DNA, 1758 bp, Homo sapiens
ttcccttctcctggattcttagtgacctctttccacttctaatcagaccccccccaccccatctctcctgcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcaggcccagctgttgagggttttcttgatgaatgaatggggtaccatacatggttaagataaagccttgggctccggactttatctgaggtgtctggagaagttctcctgcccctccacttttttgcatctactctcactaaatgagtataatgtcaagccccaactttctaaaattataggaataaatggtagcagatacatccttctaacttgttatggaggactataaatgaagttactaaaaacaatagactgaaatttttagtttaaaatatgcaagcctgaacaaggggaccaacattcccaagaaactggaacccagtcagacatatgatcaactgcttaatgtgtatgccatgtatgtcatgtgtcattcctttcccccaccccctccctagtggaagtgcttgcctactcccctaggacaggtaagtcctcggaaagtctaatcctcaatcttttgggcacaagttttataagggccaaccaagcatggagtcagggaaaaataggatcgagggccacaaaaaaagatggaagtggtaaaatagaagaaaaca

SEQ ID NO: 284045 - DNA, 2303 bp, Homo sapiens
tcccggggggccaggggcgggggccctggaaggagcgggagttcaagccgagcagggacggggctaggggtcggggggtgggggcagaaagctgaagctgacacccgtgcatccggacaccgcacgagcatcgcctgtgacagcgccccgggtccggtggagggcagcggggggaggagggaaggaggaggagaaggaggaggaggcgggagcagcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccagtgtgtacttcgagatgtggtaccccttggtgggcagggtgggggagggcccagcccctccccaggtggagagccgccccctgagccttttgccaacagtgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggtaaggatggtctgggctgggatactgggcctggagaagttgagaagcacggtagtactgggctggactgaccaataaatggcaggggtacatttaattcaaagagactgactttcatctgaatcaggctcatgctaccttctgagctgagtcaccaggggtaattggtatctactctgaacctgtttcctcatctataaaatacacttaacgatatctgcattcctgatttgtcatgaagtgccagtgagtgcatacaagtacaaggaaggagcagcataaccaccaagcatggttggttgagcctcaagtaaacaaccttagaacacagaaggaaaggaccccagaccctcatttggaacctagacccagggaagtttgacgattgctaatctgtcactgagcatttcccaaaatgtggttccttcaatgaagttattcagaaaaggcttttattttgggagacaagttggaaaatatggggttcaataggtttccttactgcaggattttgacacactaatgaatagtgtgtaatattctctagagacagttgaccataagttcttttgtcacagagtacattctaggattggattctccaggacacactttgggaaaggatgctccagttcctatctgatcctccctcaaattctcccctctccttcctaactccattcctttcaggaatagcaaaccacgaaatcgcccatcattccgacagatcctgctgcatctggacattgcctcagctgatgtactctccacaccccaggagacttactttaagtcccaggtgtgctgtgggtaggaaaataaatacctaactccccttctttgcagagatgat

SEQ ID NO: 284046 - DNA, 768 bp, Homo sapiens
ccagctcacctgggccggctctctgcccagcaacctcccagcagtcagggctcctagcagctgccccctgccctgcccactggggcccaggaaaagcagagagttgctgaaggtctcccggcagtagcggctgtcactgctacggggggtgatctaggagtgaacgccacgaggcaggtggggaaggctgctctgaacgtgtctgtgactacagctccgtgagaaagttgggacccagaagatgaaaaatgagctcagtaagggaagcagaagagccgcctttagagctggaactctccccacaccatcacagcgaacagtgatgctagagccagtcacctggtgagtcagcgcatcagagtggcccacccctcaggagggccccacccaggccgttcctggcccccaggagctctggcccagccccagcacaggggagtctgtgagtcaccatcatcatttctgcctccccaactcaagtgaccttacttggatcacctgtgtgtccccaccttgaggtgacagctgggccctggcgatgggacagcatcctgagtcctggatgccttcctcctgtcaggagacctgtttcctggtgcgttacatctgggagatgccaggcctgctttcctccctcatttcctccccagcgtgcaagaacaaatcaccagtgtcaccacacctctcaatggccctgagaacttcatggactgctttcacctgtgccattgtcaacttaagaaggcccttaatatggccgggcgcggt

SEQ ID NO: 284047 - DNA, 2059 bp, Homo sapiens
ttagagacaggcctcactgtgttgtctaggctggcctcaaatttctggactcaagctatcctcctgccttagcttcccaagtagctgggactgcaggtatgcactgccacgcctggcttttattattttagtagctactgccaaaatacatccaaatagtgatagcactttacactctcactgacgtaaatggctatttcctcaggtcatgaatagtattaaattaaatccatcttttcattttttgctaatctgatcagtaaaagatgtatatctaattttaatttccagttctataatcatttgtaatgttcaatatcctttcatataatcaggagatagaagtgctgtttagggccattattttggaattgcctgtccttacccaactgcttattttctattgggttgtttttttccttactgatctctaggggatctttgtttattaaaaacattaactctttaaccatcaaatatgttgcaaatactttattcaatatgatgtcttttagtatgtagaagtttttcttttaaaaatttaattaaatctgcccattttcttcctttatgacttcctgagttttatgaaactgcttaggaaggctttccccatcccaatgtaataaatatattatctcatgttttcttttaatgatttaataattttgctttctatagttatatatttaaaatccatttggaatgtattatgaatatggtgtgagctagagccctaactttgtcttcttccaaatagataattattccatcactattgaatagacttttcctcctgacttaatctgttctacttatatgtacctatactttgctattttaatgatatataatttgtagtacctacagtttgccatattgtgctcatagtaactttgtagtattttttactatctaatacggcaagtattcctttaactttgatccagtcaaatgtatacatcattcatcattttcccaaaaatatttacaatgttagatgtgtatcctactggatgagattctttaattaatgtttttttcatatttttgaatttaaaatcctgggaggcattgcactgtaatagtaagtctgcccatccaggatcatgcatgtcttttctttcattcaagtcttattttatatctttcagtaaattttcatatagatcttgtgaatcgaattatttttacatttcaaattcaactaacaattattaatagaaaatgaaaacattgatttttttcaatatttattttgtgtccaagtatatattaaatattttaagtagactttcttggatatttgaagtatattctgcaaataatagcatcctgtgatccagcaatcattttaggaatctatcctatagaaatagcaatgtagtagcctggtgcggtggctcacgcctgtaatcccagcactttaggaggccgaggtgggtggatcacgagatcaggagttcaagaccagtctggccaagatggtgaaaccccgtctctactaaaaatacaaaaattagctgggcgtggtggcaggcacctgtaacccagctactcgggaggctgaggcagcagaatcgctagaacctgggcagcagaggttgcagtgagccgagatcacaccactgcactccagcctgggcaatagagtaagactccatctcaaaaaaaaaaaaaaaagaaagaaagaaataacaacgtagacataagaatatgtgtgtgtataaaatattcatttcagcattgttccaaatataaaaaatattaaaataatatgggagccatataataaattatgacatacacatatgcagttattaaatagcgggcaatagagctacatggactggtgtaggaaagtggccatgtatatagttacatgaaaaaaagcaatttaaaaatatgtatagcaagtcccttttctataggtatatttatatatatacatacacacaaaatggcatttaatgcttatttaatttaaatattttatttgtgtgtgtttgttttaaatgtctgtataaacataagaaaaagtcatgaaataaacacaccc

SEQ ID NO: 284048 - DNA, 722 bp, Homo sapiens
ttagagacaggcctcactgtgttgtctaggctggcctcaaatttctggactcaagctatcctcctgccttagcttcccaagtagctgggactgcaggccctgaagaactgaactctccattcaccagcacaggatcaggacagtggcccactgaagaagaaaataagcaataagctgaaagggcaaagctgaagcccaacacagcaaaggccagacctcctcagtcttcagtgagaaaacagcaaattagagttaatactgcacatttttaattgagtgaagtacatggtactaccatatcaatgcagaatgaaaaaaagaggagattgacctaagtacagcccaaaagagctttgtcatgcacaagaacaacatgaattggcaactgaaagtaattaatcacgtaactgaaagttaccaatcgtatgtttattgtactgttatattaagcatggctcaaaatagtgagactatgtttgaagcaagtatttccttccctttcaaccagccaaatatacacttacttagcattttttattttgttgtgctttttcccatggcatggaaaaaaacaggagagaatgcacagggatatatgagtttggttatatgaatgaaggataataatatcggtgtgctctactctaggtatacaagagaactaatgcaactattctttaaaaaataatagtaataaataggatatggattaattattcccc

SEQ ID NO: 284049 - DNA, 629 bp, Homo sapiens
gggtagtagaacaatgggattatgctgtcacaaaaaccaaagaaaaaacaacacaggctccaaacataatttcttaaatcatggtctgccactgaatctggctataaaaccttatcttgcactaaaaggatctgtagctttcccagctgagaatggagttcagaatactgaatcaacacaagaaaagagagaaattggggatgaagaaaactcagctaaatttcctataggaaggagagattttgacatattctcagaccacttctaccaaaacataaatctgtgattgtgatctctgaaagtcagtccttttatctactcaataactgatctgataatgtcaacttttgaaaacagatagttatgactcaaggctttgagaatgtaaagagaccaccttcacttgttgagaaatggtacgatttcacgttatcagtgcagttccgttctcgggggaaagcccatccgtactaccaggagactggatccgcaaagtagacacttggtctcatgaagccactgctgggctccagagagaagggaaaactaagaggttttaaaacccctaccctccttggtttacctccatcattaaaaaacaacaatgacaacgacaacaaaaaacaaaa

SEQ ID NO: 284050 - DNA, 513 bp, Homo sapiens
ctagatccattctttttttcttaataaattttgtgtgataattatagtcctttaaacaatttaaactttcttcttccttcagtgctcagatgtatgctgggaagagtctaccgaccttgttggcaagtctgatacctgttggtccacatcatcttttcagaagaaaataaaagcatttaattgccaatgggaggagaagcccatactgctactataacttgtgtatgttaaatgtctgttttaaaagaaagtagtgttaagatgtatcagtaactgaaatgatatgctttctctgtgcattaaactttgtgaaaattctgcataattatgacttactagtatttttaaacaatgcttaacatactaaccttacatacactgtagaccaaaataataaatcatcataatttacaccttgatctcttaaaaattaagcatgtctttggtgaatggtttataaacccatttctcccatctgctttcaggacacaaatcagtactcaaaaaactcct

SEQ ID NO: 284051 - DNA, 960 bp, Homo sapiens
tcccccgggctgcaggattcggcacgagagaaatttttcattttctttcttgtttgactgtatgcaaacatcaaactaagaatggcaaaaatgaatctctcttcctatatattaatactaactttttctttgttttctcaaggtattttactttcagcatccaagtccataagaaatttagatgatgacatggtatttaatacattcaggttggggaaaggctttcagaaggaagacactgcagaaaaatcagttattgctccttccctggaacaatataaaaatgatgagagcagtttcatgaacgaagaggaaaataaagtttcaaagaacacaggctccaaacataatttcttaaatcatggtctgccactgaatctggctataaaaccttatcttgcactaaaaggatctgtagctttcccagctgagaatggagttcagaatactgaatcaacacaagaaaagagagaaattggggatgaagaaaactcagctaaatttcctataggaaggagagattttgacatgctcagatgtatgctgggaagagtctaccgaccttgttggcaagtctgatacctgttggtccacatcatcttttcagaagaaaataaaagcatttaattgccaatgggaggagaagcccatactgctactataacttgtgtatgttaaatgtctgttttaaaagaaagtagtgttaagatgtatcagtaactgaaatgatatgctttctctgtgcattaaactttgtgaaaattctgcataattatgacttactagtatttttaaacaatgcttaacatactaaccttacatacactgtagaccaaaataataaatcatcataatttacaccttgatctcttaaaaattaagcatgtctttggtgaatggtttataaacccatttctcccatctgctttcaggacacaaatcagtactcaaaaaactcct

SEQ ID NO: 284052 - DNA, 649 bp, Homo sapiens
  misc_feature (1)..(1): n is a, c, g, or t
  misc_feature (6)..(6): n is a, c, g, or t
  misc_feature (10)..(10): n is a, c, g, or t
  misc_feature (13)..(14): n is a, c, g, or t
  misc_feature (17)..(19): n is a, c, g, or t
ntcttnacanaanncannnaacacaggctccaaacataatttcttaaatcatggtctgccactgaatctggctataaaaccttatcttgcactaaaaggatctgtagctttcccagctgagaatggagttcagaatactgaatcaacacaagaaaagagagaaattggggatgaagaaaactcagctaaatttcctataggaaggagagattttgacatgctcagatgtatgctgggaagagtctaccgaccttgttggcaagtctgatacctgttggtccacatcatcttttcagaagaaaataaaagcatttaattgccaatgggaggagaagcccatactgctactataacttgtgtatgttaaatgtctgttttaaaagaaagtagtgttaagatgtatcagtaactgaaatgatatgctttctctgtgcattaaactttgtgaaaattctgcataattatgacttactagtatttttaaacaatgcttaacatactaaccttacatacactgtagaccaaaataataaatcatcataatttacaccttgatctcttaaaaattaagcatgtctttggtgaatggtttataaacccatttctcccatctgctttcaggacacaaatcagtactcaaaaaactcct

SEQ ID NO: 284053 - DNA, 879 bp, Homo sapiens
acacccagatcataaacatatattttctttatgtataccgacaagagaggaaaagtctagggtattttactttcagcatccaagtccataagaaatttagatgatgacatggtatttaatacattcaggttggggaaaggctttcagaaggaagacactgcagaaaaatcagttattgctccttccctggaacaatataaaaatgatgagagcagtttcatgaacgaagaggaaaataaagtttcaaagaacacaggctccaaacataatttcttaaatcatggtctgccactgaatctggctataaaaccttatcttgcactaaaaggatctgtagctttcccagctgagaatggagttcagaatactgaatcaacacaagaaaagagagaaattggggatgaagaaaactcagctaaatttcctataggaaggagagattttgacatgctcagatgtatgctgggaagagtctaccgaccttgttggcaagtctgatacctgttggtccacatcatcttttcagaagaaaataaaagcatttaattgccaatgggaggagaagcccatactgctactataacttgtgtatgttaaatgtctgttttaaaagaaagtagtgttaagatgtatcagtaactgaaatgatatgctttctctgtgcattaaactttgtgaaaattctgcataattatgacttactagtatttttaaacaatgcttaacatactaaccttacatacactgtagaccaaaataataaatcatcataatttacaccttgatctcttaaaaattaagcatgtctttggtgaatggtttataaacccatttctcccatctgctttcaggacacaaatcagtactcaaaaaactcct

SEQ ID NO: 284054 - DNA, 591 bp, Homo sapiens
gggtagtagaacaatgggattatgctgtcacaaaaaccaaagaaaaaacaacacaggctccaaacataatttcttaaatcatggtctgccactgaatctggctataaaaccttatcttgcactaaaaggatctgtagctttcccagctgagaatggagttcagaatactgaatcaacacaagaaaagagagaaattggggatgaagaaaactcagctaaatttcctataggaaggagagattttgacatattctcagaccacttctaccaaaacataaatctgtgattgtgatctctgaaagtcagtccttttatctactcaattatgactcaaggctttgagaatgtaaagagaccaccttcacttgttgagaaatggtacgatttcacgttatcagtgcagttccgttctcgggggaaagcccatccgtactaccaggagactggatccgcaaagtagacacttggtctcatgaagccactgctgggctccagagagaagggaaaactaagaggttttaaaacccctaccctccttggtttacctccatcattaaaaaacaacaatgacaacgacaacaaaaaacaaaa

SEQ ID NO: 284055 - DNA, 669 bp, Homo sapiens
gggtagtagaacaatgggattatgctgtcacaaaaaccaaagaaaaaacaacacaggctccaaacataatttcttaaatcatggtctgccactgaatctggctataaaaccttatcttgcactaaaaggatctgtagctttcccagctgagaatggagttcagaatactgaatcaacacaagaaaagagagaaattggggatgaagaaaactcagctaaatttcctataggaaggagagattttgacatattctcagaccacttctaccaaaacataaatctgtgattgtgatctctgaaagtcagtccttttatctactcaagtagaaatatgggtatatagaaaggaagaaagcaaggctaacggtgagcagtggctaaatgaacaagagaacattcagttatgactcaaggctttgagaatgtaaagagaccaccttcacttgttgagaaatggtacgatttcacgttatcagtgcagttccgttctcgggggaaagcccatccgtactaccaggagactggatccgcaaagtagacacttggtctcatgaagccactgctgggctccagagagaagggaaaactaagaggttttaaaacccctaccctccttggtttacctccatcattaaaaaacaacaatgacaacgacaacaaaaaacaaaa

SEQ ID NO: 284056 - DNA, 444 bp, Homo sapiens
tcaggcctggcgtccagaacttaagagttggctccgggcggcaacggggatgcagaagcgagcgagcctgcgagagcaccgaggctagcctccgaggcgaaccccagaaacgccaggacgggtaacttgcccctttgcgcttccccgctcagcgcactcagtttgcggctgggaatgaccctcgccgcccgccgttcttcttccggaagtcgttggccgttaccatagtgactgcaggcgtccggagcgctgagcagagtcccagctgctagggaggctgaggcaggattgcttgagcctgggaagcggaggttggaggaagccgtgattgtaccactgcattccagccagggcaacagagcaagactccatctcaaaaataattgtccatttcatccaagttgtataatttgttggcataaaattgttcaaaggatcctcata

SEQ ID NO: 284057 - DNA, 585 bp, Homo sapiens
tcaggcctggcgtccagaacttaagagttggctccgggcggcaacggggatgcagaagcgagcgagcctgcgagagcaccgaggctagcctccgaggcgaaccccagaaacgccaggacgggtaacttgcccctttgcgcttccccgctcagcgcactcagtttgcggctgggaatgaccctcgccgcccgccgttcttcttccggaagtcgttggccgttaccatagtgactgcaggcgtccggagcgctgagcagaggtgcagtggctcatgcctgcaatcccagcactttgggaggccgaggcaggaggatcacaaggtcaggagttccatacaagactagcctgcccaacatggtgaaaccccgtctctactgaaaatacaaaaacagcctggcgtggttgtgtgcacctgtaatcccagctactcaggaggcagaggcaggagaactgcttgaacccgggaggcaaaggttgcagtgaacagagatcgggccactgttatccagcctgggtgacagagtgagactccatctcaaaaaataaataaataaaataagtatttccttttaatgctaacatgaa

SEQ ID NO: 284058 - DNA, 889 bp, Homo sapiens
aaataaaagaggtttaattggctcacggttctgcaggttgtacaggaagcatgatgctgtcacctgctcggaggcctcaggaaacttacaattatggcagaaggcaaaggggaagcaggacatcttacatggctggggcgggagggagacagttggtggaggaaggtgccacacacttttaaataaccagagctcatgagaactcactcactattgtgaccacagcaccaaggggggatggtgttaaaccatgacaaaccacctctgtgatccagtcacctcccgccaggccccacctccaacactggggattacaattcaacatgagatttgggcggggacacacagccaacccgtatcagaacaattcctaataaatctctttcccataccccttgcatcagggtctgcacctggagactcccacctaagatgggggtttagatgagaccactctgggaggacacgcagccgagtgtggaggccccgaggaagatcagctctgaagacacaggcaggcaaagggcagacctcgaaggagatggaggaggaatgacagagggcaagaagaatcaggtttactgtctgccaggctgccaaaccccaaccctcgccacatccgcagccaccacgtaaagtgactgttagaacttcaaacgaaggatctgacccccggaaatggcctcatgctagttttttcctaaacagtcaccaggaaaatgacggaaggcaaatcgaaacgcatgccctgaaagacttagaacataaccatcacatctgggggacaagaagcccaccccaacttaatttaaaaaggaaacacagcagatgtcatcagttggcagggaggtgtcttgaaggaaagaaggaggggaatgagagggctgtg

SEQ ID NO: 284059 - DNA, 480 bp, Homo sapiens
cacagaggaaaggcccagtggaggacacaggaagaaggcagccatctgcaaaccaggaacagagacctgaccagaaacagaatctgctggcacctgatctgggacttgcagcctctaaaatgcctgtttcagaagaattccacaaaatgagtaaaattacagaatattttgaatatataaagatatacaaaatatcttacagtgaacatacagaacagaaaaatacaaccagactctaccagaaaatccactactcttttgaagtcagccacacagtattctcttttcatttccatgagtacgctgtcggaggcagactggactggtatgtgcagaaaagcgtagactctggggtgattaaggatttttgccatttccttaaaaaaatggaaggagaaaacactaatcattttaacaaattgtggaatggttttcctcacatcaacaccacaagcgcaagcaaataaacatactagctga

SEQ ID NO: 284060 - DNA, 431 bp, Homo sapiens
agttttttaaaacaataacatcatttattttgctcagaaatctgcagactggacagggctcagcagggataggttgtctgtgctcactcagcataagctgggacagcttgcaggctgaggcctgaagtcatgtgaaggctctctctcacgcatctggtggttgatgctggctgatggctgagattcaagctggcgtgcctgccagagcactcacagatgcttctccatgtcacctgggcttccttccaacatggtggctggtgttccataggtaagtggctcaaaatagaaagagccaggtggaagctgtgttgccttttaggatttgtcttggaagtcacatgatatctttcttgccatagtctaaccattgaggcagtcttaaggggaagggaaatagactccacctttaaactgagagagtgaccggc

SEQ ID NO: 284061 - DNA, 554 bp, Homo sapiens
agttttttaaaacaataacatcatttattttgctcagaaatctgcagactggacagggctcagcagggataggttgtctgtgctcactcagcataagctgggacagcttgcaggctgaggcctgaagtcatgtgaaggctctctctcacgcatctggtggttgatgctggctgatggctgagattcaagctggcgtgcctgccagagcactcacagatgcttctccatgtcacctgggcttccttccaacatggtggctggtgttccataggtgatcactgcggagtgccagagccccaccaaagcaatcagtactaaggggtctctcctttcctatggacaggaggggagggctttgagtctctagcagtcccctgacatataatagatgcatcctgatacctccacagttattccgaaagtgtggggtttggagatagcccaaattgggttcaaatccccttctgctgctgtgtgcctttgggaaagctacttgactaccctgagcctatttccttagcctataaaatgtggaagatacagaactgttgtga

SEQ ID NO: 284062 - DNA, 990 bp, Homo sapiens
agaggagacacgccggggcccagcgccggccggcctgaccccctcagtctgtctctatgggcgcgcgccgacagcctcgcgcaccggccccggggccccggctgagggtgcgcgcgcagcaccccgggaaggtgggggggaggcggtggcggaaagatgcgcgcgcagtcagccgtcatgggagggggaactgtggggcgttcgccatcttgtctccctctccttacctgcgtcctcgggggcgtgcgcaccaccccccctcccgcctaggaggggggagggccccctcttggccaccgccttcgcggcctttaaactcccctggagactgcggctactgccaccgccttgcctccactgcctcttcgcgcagcacacagatgcggacggtgggtgggaaaaagggcagacgctactcccagcgaaccgccgctgccgctcccgaggcctcaccaaaatggccgccgccgtctcggccgccaccaccaccactaccaccaccactcgctcggaatcgctatcgccggcgcggcccgtcttctcgcgagagacagtaactggagggtgggggaacggggaggctcgcgtgctagcgtagggtgcagcacggtgcgcaaggcagcctgggaggtgtagtctcccagaggctgcgcgctcgcccttcctcggagcgcctttaccgtttgcccctagatctacctggggctgcattgcggctgccagctcggaccaccgccacctccctttttatttacagatcacccagtaagctgcagcaagttagcagtggaacctgggcctcccgattcccatggcagcccacttctgtagcgctgcttcgttttacgcgaggatggtttcctgatagctttcaaacacctttgccatctcttcgcaaactttctagattaagaatccctttgagaatctgatacctttaccccagaatagaacaataaataacagctaccttctactgacactacttgg

SEQ ID NO: 284063 - DNA, 314 bp, Homo sapiens
gctcgtcatccaagcccgtcagggagcccccccatcacccgaccgcgaaaggctgagagaagggagggttcgtgccaccagatcacccagtaagctgcagcaagttagcagtggaacctgggcctcccgattcccatggcagcccacttctgtagcgctgcttcgttttacgcgaggatggtttcctgatagctttcaaacacctttgccatctcttcgcaaactttctagattaagaatccctttgagaatctgatacctttaccccagaatagaacaataaataacagctaccttctactgacactacttgg

SEQ ID NO: 284064 - DNA, 201 bp, Homo sapiens
gctcgtcatccaagcccgtcagggagcccccccatcacccgaccgcgaaaggctgagagaagggagggttcgtgccaccaggtcctggtcccccggctagatgtggtgggcgcgcgccccgactactcgtcccacgccccccttcctcttcccgcgcgcccctgaggggtgactgggttggtgggcgggcaggagcgcacc

SEQ ID NO: 284065 - DNA, 786 bp, Homo sapiens
agaggagacacgccggggcccagcgccggccggcctgaccccctcagtctgtctctatgggcgcgcgccgacagcctcgcgcaccggccccggggccccggctgagggtgcgcgcgcagcaccccgggaaggtgggggggaggcggtggcggaaagatgcgcgcgcagtcagccgtcatgggagggggaactgtggggcgttcgccatcttgtctccctctccttacctgcgtcctcgggggcgtgcgcaccaccccccctcccgcctaggaggggggagggccccctcttggccaccgccttcgcggcctttaaactcccctggagactgcggctactgccaccgccttgcctccactgcctcttcgcgcagcacacagatgcggacggtgggtgggaaaaagggcagacgctactcccagcgaaccgccgctgccgctcccgaggcctcaccaaaatggccgccgccgtctcggccgccaccaccaccactaccaccaccactcgctcggaatcgctatcgccggcgcggcccgtcttctcgcgagagacaatcacccagtaagctgcagcaagttagcagtggaacctgggcctcccgattcccatggcagcccacttctgtagcgctgcttcgttttacgcgaggatggtttcctgatagctttcaaacacctttgccatctcttcgcaaactttctagattaagaatccctttgagaatctgatacctttaccccagaatagaacaataaataacagctaccttctactgacactacttgg

SEQ ID NO: 284066 - DNA, 851 bp, Homo sapiens
ttcatttttaaatataaattaaactttattaattgatataaatttatattaaactttaaatttttataacctattcttacaacgtgctcatatcaatcaatgcctctatacatggatatggttaagaaacttacattttatattgattttttaaaggttaaagaaagagggaccaattaacttcaccttttcctaaacttgaaaagacaaaccaaattctgcccttcatctccaatgtttgaaagatcagaggttcctgtcaagtaagtcatcctttcttcataactattgaaaaagaaataatcagaaatcgctgaataggtcaattaaaaccatttttatcaaatatattcattcacaacatgtattgttgtagttaaaaactggttgagaaagtttacttgtaattattccgcactttgatatctgtcgattatttctggagcaaaggcaggcttattcattaggtgcctttagctaatttttcctgctattcttgctggatactttagaaatgagaaggggtgagctgtaagataaatgagtgtcactaagggaaatataagcctgcctttctcaagggctgagctccgggaggcgggaagagttcagagcattgggccagggctcatctggtgggttcaagcacacagcctcaactcccttgcaggaacatgggtccgtgtgtggttcactctgaagcatctgtcttcctgtgaaagagcttgcggctggtgagtggatactgagcccaacttctgcaggctgccctcccctctggataccaagcccacccatggcaatcccttcaaggcgtgactctcatgataattaaatgtgtgataatgtga

SEQ ID NO: 284067 - DNA, 340 bp, Homo sapiens
aaattgccgagaagcacttctgccaaaggctaaaggatggtaaaagaaaaaggttaaagaaagagggaccaattaacttcaccttttcctaaacttgaaaagacaaaccaaattctgcccttcatctccaatgtttgaaagatcagaggttcctgtcaagaacatgggtccgtgtgtggttcactctgaagcatctgtcttcctgtgaaagagcttgcggctggtgagtggatactgagcccaacttctgcaggctgccctcccctctggataccaagcccacccatggcaatcccttcaaggcgtgactctcatgataattaaatgtgtgataatgtga

SEQ ID NO: 284068 - DNA, 477 bp, Homo sapiens
tagtagagatggagtttctctaccccatctctgaccatgttggtcaggctggtctcgaactcctgacctcaggtgatccacctgtctcggcctcccaaagtgttgggattacaggtgtgagccaccacgtccattctattccaagaacttttataagattttgtctttgtattcttcagagtttaacaactcctttgtggatgcattgggttctgatgaggactctggaaatgaggatgtttttgatatggagtacacagaagctgaagctgaggaactgaaaagaaatgctgaggtaattgttttcattcctgagtacagttggtcaaattcagtgtcactcttcccactctttacttcaaaggccccactttcagtgtccactgcaggttcattttggccctttcagtagccattagatggtctcattttctcttgtcatttgctgttcatttttcacatacaagatttaaaaaa

SEQ ID NO: 284069 - DNA, 289 bp, Homo sapiens
cgccatcagccgctctccctgactaggggtagctagcggcctccctcctttgggttctgtatccctacttccattaccctcggctcctcccactcctcgggggctccgtgctttccgcgggtctgtccgggggctccggaccctcggcgcagctgagttgatggcttccggagaactggcatagctgcagaatatgagtagtctcccaaagtgctaggattacaggcatgagccaccacgcccagccccagctgatctttctaaccaacaccacaaaggtgccaaggga

SEQ ID NO: 284070 - DNA, 5811 bp, Homo sapiens
cgccatcagccgctctccctgactaggggtagctagcggcctccctcctttgggttctgtatccctacttccattaccctcggctcctcccactcctcgggggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaagttatttgccatacagtaaccagagacctccaactaggggcccccaaactgtatcctgcctgtagaacctgccaggtaaaggtatatttttgctttttaatttagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggcctcgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctataggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacgaaaacaaaaacaaaaaaaacacaaaccatcatcacagaagatgcaacatcttttctgaaagattgccttaagagagctccagtcctactcttggaacttggatgtattctaatgtagtaaactattctaagttttcattctttgaattataaatggcctcagcagttttgctcaactactgataaatgctttgcctcctaccatctacctatataccttattgtaatgaatgttccaaaatggtagagtggtagaaaacgccagagtagtttagagcagaggaaaatatttgttttaaaactagctttaaagttttgtttcatttctaccaggagcctctttggtttggtttgattttgcttggaaataattggttttcttataaatgagtgaagcggtgataaaattctttggctagttattaattcttttacgtgtctttgcatttgagaggcactgttaaaaattattgggaaagatttaaagtgcaggctgcaattaaaacatggagaaaagtagaaataatgccataagtctagattgcctcatgaagcagcctcatttgaattgctttcatagctttcatgtgtgtatggtttagaagtacacttacctcagaaacctgatttgatcttcatgtcttgggcaggagttgttgaaaataggttattggaatatataagttatctcactgctcatgtacttgcatgtttgggactcaaattttacttgatgtctgtccattcttgtggccctatcagccttctccttcctttactcctttaatctacttctttgactaccagtggagatttcagctggactatgttgat

SEQ ID NO: 284071 - DNA, 3315 bp, Homo sapiens
cgccatcagccgctctccctgactaggggtagctagcggcctccctcctttgggttctgtatccctacttccattaccctcggctcctcccactcctcgggggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgggctggctggaacagtcgtgaggaccatacttctgggttggcagtatgcactgcatattttgttacaa

SEQ ID NO: 284072 - DNA, 686 bp, Homo sapiens
cgccatcagccgctctccctgactaggggtagctagcggcctccctcctttgggttctgtatccctacttccattaccctcggctcctcccactcctcgggggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaagtaagtaatgtttttgttttggatatatgtttcaaagagcatgcaatctggcgggaactgacagttttgtgtttgttttgtagtaatagtttttgtgttttggccatactttatttaccactgaatgctctctgattaaggatgttttcaaagcagtacctaaaatgtgagcacttaaataaatgtacagggcatagaaacatttttgctaatattgttgctttgagcattcatggtgatgctcaaagttgaacagtaattttaataattgtgaagaaatttagagaaagaatctctggacatatttaaagaataattcattttaattatcttttgtcttcttatttttttgctttaataagacaattaccattaccgagttaaggaaaccct

SEQ ID NO: 284073 - DNA, 618 bp, Homo sapiens
tcccgccatcagccgctctccctgactaggggtagctagcggcctccctcctttgggttctgtatccctacttccattaccctcggctcctcccactcctcgggggctccgtgctttccgcgggtctgtccgggggctccggaccctcggcgcaggtaaggcgggccggggtagcttctcaattgagccgttttccctacctcctcctccttctgtgcgatccgcccactcggcgttcactcctctggagttcgccctgctgctactcagcccgcccacaacccctcgatgcacccccagcctcacaggtactacctttgggtgcactgccccggcttccacctctcctttgacttggtctccactgccactcgctccctccgaaactcaaacctggccccttttctctggggctgttgtcgttcgcctcttaccttctaacagggcctgctgtctcttcaggtgactttcgttacggcacatccaccaggccttggacatgatactcattcactctcttgaccatcttcaccttcctcttgaccagtcctcactgcaaaacatgaattgtatttttgttgtgcatttccttgcgcccatttctagccgccagatcag

SEQ ID NO: 284074 - DNA, 5816 bp, Homo sapiens
cgccatcagccgctctccctgactaggggtagctagcggcctccctcctttgggttctgtatccctacttccattaccctcggctcctcccactcctcgggggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggcctcgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctataggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacgaaaacaaaaacaaaaaaaacacaaaccatcatcacagaagatgcaacatcttttctgaaagattgccttaagagagctccagtcctactcttggaacttggatgtattctaatgtagtaaactattctaagttttcattctttgaattataaatggcctcagcagttttgctcaactactgataaatgctttgcctcctaccatctacctatataccttattgtaatgaatgttccaaaatggtagagtggtagaaaacgccagagtagtttagagcagaggaaaatatttgttttaaaactagctttaaagttttgtttcatttctaccaggagcctctttggtttggtttgattttgcttggaaataattggttttcttataaatgagtgaagcggtgataaaattctttggctagttattaattcttttacgtgtctttgcatttgagaggcactgttaaaaattattgggaaagatttaaagtgcaggctgcaattaaaacatggagaaaagtagaaataatgccataagtctagattgcctcatgaagcagcctcatttgaattgctttcatagctttcatgtgtgtatggtttagaagtacacttacctcagaaacctgatttgatcttcatgtcttgggcaggagttgttgaaaataggttattggaatatataagttatctcactgctcatgtacttgcatgtttgggactcaaattttacttgatgtctgtccattcttgtggccctatcagccttctccttcctttactcctttaatctacttctttgactaccagtggagatttcagctggactatgttgat

SEQ ID NO: 284075 - DNA, 5854 bp, Homo sapiens
cgccatcagccgctctccctgactaggggtagctagcggcctccctcctttgggttctgtatccctacttccattaccctcggctcctcccactcctcgggggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagtattctggtttcttctaaaagtaactctcttcttcaggattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggcctcgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctataggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacgaaaacaaaaacaaaaaaaacacaaaccatcatcacagaagatgcaacatcttttctgaaagattgccttaagagagctccagtcctactcttggaacttggatgtattctaatgtagtaaactattctaagttttcattctttgaattataaatggcctcagcagttttgctcaactactgataaatgctttgcctcctaccatctacctatataccttattgtaatgaatgttccaaaatggtagagtggtagaaaacgccagagtagtttagagcagaggaaaatatttgttttaaaactagctttaaagttttgtttcatttctaccaggagcctctttggtttggtttgattttgcttggaaataattggttttcttataaatgagtgaagcggtgataaaattctttggctagttattaattcttttacgtgtctttgcatttgagaggcactgttaaaaattattgggaaagatttaaagtgcaggctgcaattaaaacatggagaaaagtagaaataatgccataagtctagattgcctcatgaagcagcctcatttgaattgctttcatagctttcatgtgtgtatggtttagaagtacacttacctcagaaacctgatttgatcttcatgtcttgggcaggagttgttgaaaataggttattggaatatataagttatctcactgctcatgtacttgcatgtttgggactcaaattttacttgatgtctgtccattcttgtggccctatcagccttctccttcctttactcctttaatctacttctttgactaccagtggagatttcagctggactatgttgat

SEQ ID NO: 284076 - DNA, 3206 bp, Homo sapiens
cgccatcagccgctctccctgactaggggtagctagcggcctccctcctttgggttctgtatccctacttccattaccctcggctcctcccactcctcgggggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgaggtaattgttttcattcctgagtacagttggtcaaattcagtgtcactcttcccactctttacttcaaaggccccactttcagtgtccactgcaggttcattttggccctttcagtagccattagatggtctcattttctcttgtcatttgctgttcatttttcacatacaagatttaaaaaa

SEQ ID NO: 284077 - DNA, 1655 bp, Homo sapiens
agcgggggcggcgtgacagctgccagctcaccggctcagacggtcgccgccgcgtttgcgcagggggagctggtcgccgccgcggccgcctggaattgtgggagttgtgtctgccactcggctgccggaggccgaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284078 - DNA, 1738 bp, Homo sapiens
agcgggggcggcgtgacagctgccagctcaccggctcagacggtcgccgccgcgtttgcgcagggggagctggtcgccgccgcggccgcctggaattgtgggagttgtgtctgccactcggctgccggaggccgaagctattacttctctactgaggccaactgtgagccctggtgtgtttcattggcaggagaagaggctaattaagtgaaactgaaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284079 - DNA, 1392 bp, Homo sapiens
agcgggggcggcgtgacagctgccagctcaccggctcagacggtcgccgccgcgtttgcgcagggggagctggtcgccgccgcggccgcctggaattgtgggagttgtgtctgccactcggctgccggaggccgaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggacccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284080 - DNA, 1335 bp, Homo sapiens
agacagtgggggaaagcatgggactttttgatgtggagtaaagccagagaaggaaaattcatctactcacaggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284081 - DNA, 1149 bp, Homo sapiens
cgctctagagatcccctttagatcactaggtcctttagatgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284082 - DNA, 694 bp, Homo sapiens
agcgggggcggcgtgacagctgccagctcaccggctcagacggtcgccgccgcgtttgcgcagggggagctggtcgccgccgcggccgcctggaattgtgggagttgtgtctgccactcggctgccggaggccgaagctattacttctctactgaggccaactgtgagccctggtgtgtttcattggcaggagaagaggctaattaagtgaaactgaaagaacaaataaaatgatgagtccagtttctgtggctgatttcacagacccctcgagagacagcacggctatggaaagagcatggcttttggggccaaactggctttgaattctgactctactgctctgtggctgcatgaactctggcacgttacttaacctctctgaattttggtcccctcatgggtaaaatgagcagcatattggaaccacctcagagggttgtcgtgaagagtaaatgaactaatactttgcttgcaacatggaaagttctctataaatgttgactataattattatttgacagaattaattttcctctgggatgcccagatagtatatttgaatgctgggggaaggggtggcactagggtatttctctgtctccgccatggcggagttattattacatttccacaaagtggaaggactaaagcctccgggcagtctgaggcatggctgagagcccagagaagg

SEQ ID NO: 284083 - DNA, 531 bp, Homo sapiens
agcgggggcggcgtgacagctgccagctcaccggctcagacggtcgccgccgcgtttgcgcagggggagctggtcgccgccgcggccgcctggaattgtgggagttgtgtctgccactcggctgccggaggccgaagctattacttctctactgaggccaactgtgagccctggtgtgtttcattggcaggagaagaggctaattaagtgaaactgaaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagggtgccagcgtgggtgggcttctcaggcaggaggacatcttggcagtgctggcttggccattaaatggaaacctga

SEQ ID NO: 284084 - DNA, 269 bp, Homo sapiens
ttccttgacatgcctgtcagaaggtcactcagctggtccatgtgcacttttttcaggtggcactcaccccacaaaacagcctgttcagatttagacagttttcactgttagaaaattctacttcatattgagatagaggcatttgttctccttacagtcactccaaattgggaaggatctttcatcttccctcattcctccaggtaggcctatacttggagtggcccaggtcagacaattactcctttctaacaaccatgtaagaaata

SEQ ID NO: 284085 - DNA, 843 bp, Homo sapiens
ggaccttgaagcttgttcctggtcagaatagaagtggggagctatcttcattccattcagccagctttgggggcacgcctgctgtgtgtcgggccctctcctcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284086 - DNA, 1881 bp, Homo sapiens
agcgggggcggcgtgacagctgccagctcaccggctcagacggtcgccgccgcgtttgcgcagggggagctggtcgccgccgcggccgcctggaattgtgggagttgtgtctgccactcggctgccggaggccgaagctattacttctctactgaggccaactgtgagccctggtgtgtttcattggcaggagaagaggctaattaagtgaaactgaaagaacaaataaaatgatgagtccagtttctgtggctgatttcacagacccctcgagagacagcacggctatggaaagagcatggcttttggggccaaactggctttgaattctgactctactgctctgtggctgcatgaactctggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284087 - DNA, 1793 bp, Homo sapiens
agcgggggcggcgtgacagctgccagctcaccggctcagacggtcgccgccgcgtttgcgcagggggagctggtcgccgccgcggccgcctggaattgtgggagttgtgtctgccactcggctgccggaggccgaagggcccaatccccacccccagtcttgtctgaattgtgtggaagacatgaggcactgagagaggtgggggccgagtggcctcctcccacctgctccccaaacatctgctctgggctgcagtaagctggcaatacagattggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284088 - DNA, 1784 bp, Homo sapiens
agcgggggcggcgtgacagctgccagctcaccggctcagacggtcgccgccgcgtttgcgcagggggagctggtcgccgccgcggccgcctggaattgtgggagttgtgtctgccactcggctgccggaggccgaagctattacttctctactgaggccaactgtgagccctggtgtgtttcattggcaggagaagaggctaattaagtgaaactgaaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaagtcactccaaattgggaaggatctttcatcttccctcattcctccaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284089 - DNA, 1463 bp, Homo sapiens
agcgggggcggcgtgacagctgccagctcaccggctcagacggtcgccgccgcgtttgcgcagggggagctggtcgccgccgcggccgcctggaattgtgggagttgtgtctgccactcggctgccggaggccgaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctga

SEQ ID NO: 284090 - DNA, 450 bp, Homo sapiens
tgccactcggctgccggaggccgaagtaggggcggtgagggccgcccggccctggagctgggcggggggctcagggcgcttcctgggcctcctcctgccggcggcctcggcgccttcccagcagtgttctggggacccacacatcctcactagtgtctccaaagcgggacgtccaagtgggcccggggctccctgccgaaggcctacctttcttatctttcccactcagaatgtctccattcacctctttattggcaggagatggggccgtggaaatttgagattggctttggctccgcacctgtttttagtgcccttgcctgtttcattctcccagcctaagtttccgtatctgtccgaagaaggggtggtttggtgttgatctccgagacccgtgtgtctcttcccatgtggaattattgtcactctcttattgcttgtttttctttg

SEQ ID NO: 284091 - DNA, 2825 bp, Homo sapiens
  misc_feature (2314)..(2314): n is a, c, g, or t
  misc_feature (2448)..(2448): n is a, c, g, or t
tttctttttctccttttctttcccaaccaggttgtcctggctcgagaactggcaacctccagagaatatgcgagtgagtatgggctgcagggagctgtgcgtccgggagcagggcaagcggctccgtgcagggcggctggggtggcagggccggtgtttctgtgctgatttcagggtacaggacactgttggctttagagaccaccaggctgttgtgtacaatgtttgaaagactttaatttgtaccagttacctttgtgagtcatgtctttagtgttttttgttgtttctgatagtaactcacttctctctcacctgaagttaaaattctggagaagcgacatatcataaaagagaacaaggtcccctatgtaaccagagagcgggatgtcatgtcgcgcctggatcaccccttctttgttaagctttacttcacatttcaggacgacgagaagctgtgtatcctttgcgtggttggtgccgtctgaagccacaccagtcacccctctcacttggaatcagaccctgtgtgttcccacaagcagcccccgctccctgccgagtggggtccctcaggccgctgacattcagggaggcagccgaggcagcgccagggtgtggctgggagtctgcacaggacgttacctcccggagaagccaccgatgtggctccagcacagtcctctctgctgcggcttgcttggtcggcgtcccttgctcccctagagctccatcttttctgttattaaaccttggctcaggaatctgggaggcaaggcccggtggaagttggggtgggccccacctctgccccatccagctgacctgtgggcctgccagtggctgggctggccacgccgcaccgtcgtcacccccagcaggtgcagtctgcatctgctcttctcctcccccgccaccctccaagctggcccaagtgtcgtggcctccccatcctgcctggggaggggcctgagtcctcccacctgtcctccccgtctctccccagcacccggctcttctgtgttagagcttcgttctggcctgctcccactctcagcaccatcctgcagctccttcggctgccggcggagtgtgtgtgctctctctgtttggaggtgcttgccaagtgcaggttgatgggtgatggggatgcgctgctatgccgggtggcgtctctgcccacgagaagcttcgattttggtggaggagctggacgtgcactgacgatccgtgtcagaggcttcccggcagcaagatgtgctgccaagagtcttagggctgggtaggggctggcggcagtgtggggctctttcagctcctgggcaggagtgtgtgggggggcatgaaaggctgtggtgggctgggcccctgagccgtggcagcctggcactgactctggacttccttctctttgtggcggggaacgtggggtttgctgtggcttctcctaggccaggcgggagaacgggcaggagagcaggggcaggggccgtggtcgaggtctgatgaacagaccggtcaagagaatggagtcaggggcagctcctgggaggtggccctcaagcctagtgcacagcggtgtctgctgctgagctgggagagaccggggcgggtgctgggctggcatttcatgcatccgctggtgccaccattcaggtctgagtgggcacttaggtgctgccagcagagctccaggaggagtcagggccgtgaggactttcacagcgagctggcaggctgcccagaggttggctcctctgtgagtggagcctgggttccccccagtgcaggggtgaacacgaggaggggcccaccgaggagaggagatggtgatgggatgttgctcccgagctcgaatgatggagacccagaggccacgggatcaaacgatttctgatggagggtgctggctgcccacgcaggggttatgaagcggtcaggtgcacacagcctgacccgtggatctgccctgtgccagttgttgatggtgggtaggcagtttcttggggggactgttcaaggaagagtaagaggtgaggaaatggaaacgacgcaaggtgcttccctgggattttgcctagggaggagcggggcagtggccgagcagctgccaggcacgtggcccggagcgggctttgctgttggtttgtggaaggttgtagagaatgctggcctccaggcaggcctgctgtcctccagtgtcatccctgttcctgcctctgtctcccactctcagtggcttcttcacggtatgttctgtctctcaccttcacgttccccggggccctgcacgtctctgcccccgtttgagccncgggagtccctctgggcttcccgcagagccgtcggaacacggctgcttgttggttgtgaggctgcaacagaattgcacacgcttgacctctcccatcctctcctcccgggggctcagagtccagaggagagtgnatcttgctgactgatttccaaatgggattggccagagcggtgcaggtagtgggaactccaggtctttgtccagtggtccatgttgcccttcatcattaagtcaaattccaaagccccgggaggttgtgaaggttcactcgcccctgacgggaacgagacccagggacttctgccccaccaggcatcctcggtgtgggttgtatttagagatgggcctggacaggggccactttgggcagccttggttgcaagtcccttcgcttctgggtttctcttcgttgccctgaagcttcaggttcatccttggtgggagatgatggtgccctggcaaacagaagtgagcaggcaggccagcctggctctgagcacgagccccc

SEQ ID NO: 284092 - DNA, 690 bp, Homo sapiens
  misc_feature (655)..(655): n is a, c, g, or t
tagagatccccggatgagtaaatcttgccgatctaatgattcttttcaccatcttgactgatgctttttatctttttcagttgtagcttctgtgtgtacttctttctggtctcgtttttcatgactttctgataaagtcagctcagaagtgtgcatagctttcattttgtgcgttaaaaatgatagattttacttcgttaaaaaacgacttagaatgacatggagatgtgaggtggtgaatccctactgtgtccagccaacacttgttgcttgtgagctttaggcctgtagccctggttgtcagcctgtaaggatcatatacattcattcgttcattttgttttcagcaaaatttagagtacgtaataatgttgctgttttaagtatttcttctcaaatgtgaaaatctgcttttacagggaccttaaaccggaaaacattttgttaaatgaagatatgcacatccagatcacagattttggaacagcaaaagtcttatccccagagagcaaacaaggtgtgtgagttttatttctagcagagcctggctctgtgcttcagatggaaagcgacttctgaggagtgtttgcattgtgtcatcttcatcaacgactgaggtggggataccttgccgttctcaaacagatcttgacgnccaattactcatcggtaccgagctcgatctattcc

SEQ ID NO: 284093 - DNA, 598 bp, Homo sapiens
atcgcggggggcggggcgtcgcgggcacagcgtgagggccgccgttgctggagttcagcttagggaaggaggacgctgaggaggccccgagccgcggagcgcttcgggggaggcgcccgcgcagacgcgaggcccatagccaggaccaccacctagctgttctacagtctggggacgacggtttaaaaatttatgccttgcatgcgatgtgcagtgggtgatggaagaacgtctacatggctttaaaattggatttaaaaggcaaatattttaaatgaaggaaaacccaagaagtttacttgattccttatcttccaggatgcgacttttgtttatttatttattttattttgatggagtctcgctgccgtcgcgcaggctggagtgcagtgacgcgatcttgacccgggaacctccacctcccgggttcaagcgattctccttcctcaaccacccgagtagctgggattacaggcgtgtgccaccatgcccggctaatttttgtgtttttagtagagaccggggaaggtatgggccctcttttgagaaaaatgcagagtgacactgaattttgtaactacatcaggaggctcttgaa

SEQ ID NO: 284094 - DNA, 363 bp, Homo sapiens
ccaccctcacacccaactggtctgaaaggatagaagcgcattagaggtgaaactggggccttggagacagagtgggaaatggactgggcttgtcgcttgtattttacacatgtctttgtttgtttgtttgtttcccctaccttaaagttcagacctttgggctcttggatgcataatataccagcttgtggcaggactcccaccattccgagctggtcgtcgacgacaagtgcgactccctggcgcaatagatatagtaccgcaagggaaagatgaaaaattataaccaagcataatatagcaaggactaacccctataccttctgcatatgaattaactagaaatacttgcaaggagtcgcc

SEQ ID NO: 284095 - DNA, 338 bp, Homo sapiens
aagtctggctcctgggggtgcatggtccgccatgtgcgacacccaccgcgcagcccttgattgtcacagatcgtgagtccgagtgtgaccttctctctcctctgcagccagggccaactcattcgtgggaacagcgcagtacgtttctccagagctgctcacggagaagtccgcctgtaagaggtaaccactttcatctaagccgtacttcccttttctttaacacagaaattaatatttgagagagtgaatttggtggcctttaagtagctaagcatacttgggaagaaattagcatttcgcattttaaggcgtattttccgtggcgtacacacacg

SEQ ID NO: 284096 - DNA, 1513 bp, Homo sapiens
ctgggcccgcttccggcgggagcggagcacggggtgatctgggcactaacgctgatggggagcagcggacatcagcctcgacctcccacgagcggtgcacgagcgcctgacccagacctcgaccctagccttcacccccaccctgactccagttcatgaactggtcaaaggaagagccatgccagcaaacgtctacactgtacatgctttttattacaagactacggagcataggaggaaaattcatcatctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaattcttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaatggtgccgctagaaccggacgccgagcacccccggcactggccccggggtcccacgtacggggcctcctgcccggcctgtcgcatctgcgcttggcttggtgcttgtacaactgtgcggccaagatgctccagaacactgcctgtctttccacagaaaaa

SEQ ID NO: 284097 - DNA, 1419 bp, Homo sapiens
atcgcggggggcggggcgtcgcgggcacagcgtgagggccgccgttgctggagttcagcttagggaaggaggacgctgaggaggccccgagccgcggagcgcttcgggggaggcgcccgcgcagacgcgaggcccatagccaggaccaccacctagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaattcttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaatggtgccgctagaaccggacgccgagcacccccggcactggccccggggtcccacgtacggggcctcctgcccggcctgtcgcatctgcgcttggcttggtgcttgtacaactgtgcggccaagatgctccagaacactgcctgtctttccacagaaaaa

SEQ ID NO: 284098 - DNA, 1461 bp, Homo sapiens
ctgggcccgcttccggcgggagcggagcacggggtgatctgggcactaacgctgatggggagcagcggacatcagcctcgacctcccacgagcggtgcacgagcgcctgacccagacctcgaccctagccttcacccccaccctgactccagttcatgaactggtcaaaggaagagccatgccagcaaacgtctacactgtacatgctttttattacaagactacggagcataggaggaaaattcatcatctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaattcttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagactccgacacgggcctgacccagaggtcaggcagcaa

SEQ ID NO: 284099 - DNA, 1111 bp, Homo sapiens
  misc_feature (1076)..(1076): n is a, c, g, or t
ctgggcccgcttccggcgggagcggagcacggggtgatctgggcactaacgctgatggggagcagcggacatcagcctcgacctcccacgagcggtgcacgagcgcctgacccagacctcgaccctagccttcacccccaccctgactccagttcatgaactggtcaaaggaagagccatgccagcaaacgtctacactgtacatgctttttattacaagactacggagcataggaggaaaattcatcatctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaattcttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaaggtgtgtgagttttatttctagcagagcctggctctgtgcttcagatggaaagcgacttctgaggagtgtttgcattgtgtcatcttcatcaacgactgaggtggggataccttgccgttctcaaacagatcttgacgnccaattactcatcggtaccgagctcgatctattcc

SEQ ID NO: 284100 - DNA, 1416 bp, Homo sapiens
atcgcggggggcggggcgtcgcgggcacagcgtgagggccgccgttgctggagttcagcttagggaaggaggacgctgaggaggccccgagccgcggagcgcttcgggggaggcgcccgcgcagacgcgaggcccatagccaggaccaccacctagctggaaaagaactacagcctgtgtgggtcccctcccgacaattaaaattgcaccataactccaaagatgaaacgctcccagaaagaaaaggcaaagacccatcggaaacaaaagagcaactttcaccgcctgatacatacacttcatgacatccacattgagacaaaatctcgccgtgtgacctacaacacctctcgttcaaccccacctacttggggtcgaatacagattttatctcatcaaacagaaaaattcttaacagaaaaaggaatcccaaaaatgactggtaatataattctggctgcctttatggtagtcagtgcagcgtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttataccagatatagatcttagatatgattatatacgaatatcattaatcatgagtttgtagcaattactttttattccaatattatgataatcctcgctctataatcatagcctaggaaaaaccaggccatacagagataggagctgaggggacatagtgaagtgtgaccagaagacaagagtgcgagccttctgttatgcccggacagggccaccagagggctccttggtctagcggtgacgccagcgtctgggaagacacccgttaccaggcggatcgtggcccagccgtagcaaaaggtgtcaaggaacaccttttgcaaaaggtgtcaacacccgctacttagcagactgggaaaggggggcggtctccctttccccgggggagtttagagaagactctgttcctccacctcttgtggagggcctgacatcagtcaggcttgcccgtagttatccggaggcctaactgtctccctgtgatgctgtgcttcagtggtcacgctcctagtctgccttcattttccatcctgtacacctggctctgccttctagatagcagtagtaaattagtgctgtctcctctccctctctgcctcggctgccaggcagggaagggccccctgtccagtggacacatgacccatgtgaccttacctatcattggaggtgactcacattctttaccctgccccttctggcttgtatccaataacagcgcagtcagacattcagggccactaccggtctccg

SEQ ID NO: 284101 - DNA, 730 bp, Homo sapiens
  misc_feature (693)..(693): n is a, c, g, or t
tagagatccccggatgagtaaatcttgccgatctaatgattcttttcaccatcttgactgatgctttttatctttttcagttgtagcttctgtgtgtacttctttctggtctcgtttttcatgactttctgataaagtcagctcagaagtgtgcatagctttcattttgtgcgttaaaaatgatagattttacttcgttaaaaaacgacttagaatgacatggagatgtgaggtggtgaatccctactgtgtccagccaacacttgttgcttgtgagctttaggcctgtagccctggttgtcagcctgtaaggatcatatacattcattcgttcattttgttttcagcaaaatttagagtacgtaataatgttgctgttttaagtatttcttctcaaatgtgaaaatctgcttttacagccacccggggtgcagattgtggattgtggggtaacggcaggtgggaagagggatgaggaaaacgtcacataccgggtatgtggtacacgtggtgcagtccaggcaacacagggaatcaaggctctgctgagagtcaagagccaaggcttgaacccaggctccccatactctctgcagaccagaccgcctcaaatgggttccagaaaacatcagacccagcaagactgcttaatggaaaaacatgtctcgtggtcaaataagacgaatgctgcgntattaaatcctgcttctgcagaacccacgcggatcta

SEQ ID NO: 284102 - DNA, 722 bp, Homo sapiens
atacagagataggagctgaggggacatagtgaagtgtgaccagaagacaagagtgcgagccttctgttatgcccggacagggccaccagagggctccttggtctagcggtgacgccagcgtctgggaagacacccgttaccaggcggatcgtggcccagccgtagcaaaaggtgtcaaggaacaccttttgcaaaaggtgtcaacacccgctacttagcagactgggaaaggggggcggtctccctttccccgggggagtttagagaagactctgttcctccacctcttgtggagggcctgacatcagtcaggcttgcccgtagttatccggaggcctaactgtctccctgtgatgctgtgcttcagtggtcacgctcctagtctgccttcattttccatcctgtacacctggctctgccttctagatagcagtagtaaattagtgaaaatactaatagtccctgatatgcagaaataatggcataagctgtctttctctctgtctcctctccctctctgcctcggctgccaggcagggaagggccccctgtccagtggacacatgacccatgtgaccttacctatcattggaggtgactcacattctttaccctgccccttctggcttgtatccaataacagcgcagtcagacattcagggccactaccggtctccgcacattggtggtagtggtcccccgggcccagctgccttttctct

SEQ ID NO: 284103 - DNA, 1201 bp, Homo sapiens
cacaggtattgctcctcctagaccaaaaattattcatcccttttttaccccagaacatcctgaactatggaaattagctgcagctttgtcgggaataaagatatggaacactacctatcagctccttcgtactaaaaccaaaacacccacattcaacatcacccttatttctgaatgggtgatacccattaggagctgtgtcaaacccccttacatgctgttggttggaaatataattatgatgcctgatgcacaaactatagaatgtcataactgtaagctgttcacttgcattgatgcaacttttaatcccactacaagtattctcttggtaagggctagggagggggtatggataccagtttctctacatcgtccatgggagtcttccccctctattcacatagtcaatgaagttcttaaagacatcctcaaaagaacaaagagatttatttttactcttattgcagtccttgcaggactacttgcggttactgcaacagcagcaactgctggagttgccatccgcagttctgttcaaactgctcactatgttgaagcatgccagaaaaattcctccagactttggaattctcaggcgcaaattgatcaaaaattagctaatcagattaatgatctccgccaaagtgtaacctggctgggagatagagttatgaacttgcaacaccgtatgcaattacagtgtgattggaatacttctgattattgcataacgccttatgcttataatcaagatcaacatagctgggaaaatgtctcaagacatttaaaagcctgggatgataacttaaccttggatatttcacaacttaaagagcaaatctttgaggcttcacaagcccatttatccacagttcctggctcacacatttttgaaggcataactaaacaattacctgattttaatcccttcaaatggctcaaacccgtcagaggatcattgttgttactggcattattaatattggtatgcttatgttgtctccttttagtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttataccag

SEQ ID NO: 284104 - DNA, 1206 bp, Homo sapiens
ctgggcccgcttccggcgggagcggagcacggggtgatctgggcactaacgctgatggggagcagcggacatcagcctcgacctcccacgagcggtgcacgagcgcctgacccagacctcgaccctagccttcacccccaccctgactccagttcatgaactggtcaaaggaagagccatgccagcaaacgtctacactgtacatgctttttattacaagactacggagcataggaggaaaattcatcatctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaattcttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagattgtgtctgctttagagtacttgcacggcaagggcatcattcacagggaccttaaaccggaaaacattttgttaaatgaagatatgcacatccagatcacagattttggaacagcaaaagtcttatccccagagagcaaacaagtttgttgaagaaacaagtcatttgcatctgtgtggcgttgttgaacatggtcctctctcctggccactacatcacattcagagttgattctcccctccctgttcagagactggtggtgggtgttctttatccggcatctctctgtgacagcagcagcatttgtggccataattggcctaaattcatgaactcattagagagtgcagaaaggtcacagcctgatacattcatgagatgcaattcattaaagagcaacttctccccagca

SEQ ID NO: 284105 - DNA, 1946 bp, Homo sapiens
cacaggtattgctcctcctagaccaaaaattattcatcccttttttaccccagaacatcctgaactatggaaattagctgcagctttgtcgggaataaagatatggaacactacctatcagctccttcgtactaaaaccaaaacacccacattcaacatcacccttatttctgaatgggtgatacccattaggagctgtgtcaaacccccttacatgctgttggttggaaatataattatgatgcctgatgcacaaactatagaatgtcataactgtaagctgttcacttgcattgatgcaacttttaatcccactacaagtattctcttggtaagggctagggagggggtatggataccagtttctctacatcgtccatgggagtcttccccctctattcacatagtcaatgaagttcttaaagacatcctcaaaagaacaaagagatttatttttactcttattgcagtccttgcaggactacttgcggttactgcaacagcagcaactgctggagttgccatccgcagttctgttcaaactgctcactatgttgaagcatgccagaaaaattcctccagactttggaattctcaggcgcaaattgatcaaaaattagctaatcagattaatgatctccgccaaagtgtaacctggctgggagatagagttatgaacttgcaacaccgtatgcaattacagtgtgattggaatacttctgattattgcataacgccttatgcttataatcaagatcaacatagctgggaaaatgtctcaagacatttaaaagcctgggatgataacttaaccttggatatttcacaacttaaagagcaaatctttgaggcttcacaagcccatttatccacagttcctggctcacacatttttgaaggcataactaaacaattacctgattttaatcccttcaaatggctcaaacccgtcagaggatcattgttgttactggcattattaatattggtatgcttatgttgtctccttttagtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttataccagatatagatcttagatatgattatatacgaatatcattaatcatgagtttgtagcaattactttttattccaatattatgataatcctcgctctataatcatagcctaggaaaaaccaggccatacagagataggagctgaggggacatagtgaagtgtgaccagaagacaagagtgcgagccttctgttatgcccggacagggccaccagagggctccttggtctagcggtgacgccagcgtctgggaagacacccgttaccaggcggatcgtggcccagccgtagcaaaaggtgtcaaggaacaccttttgcaaaaggtgtcaacacccgctacttagcagactgggaaaggggggcggtctccctttccccgggggagtttagagaagactctgttcctccacctcttgtggagggcctgacatcagtcaggcttgcccgtagttatccggaggcctaactgtctccctgtgatgctgtgcttcagtggtcacgctcctagtctgccttcattttccatcctgtacacctggctctgccttctagatagcagtagtaaattagtgctgtctcctctccctctctgcctcggctgccaggcagggaagggccccctgtccagtggacacatgacccatgtgaccttacctatcattggaggtgactcacattctttaccctgccccttctggcttgtatccaataacagcgcagtcagacattcagggccactaccggtctccg

SEQ ID NO: 284106 - DNA, 420 bp, Homo sapiens
cgctcaccccggggcgcgccgaggccaccgcagggcacttacttggcacttgcttttgagtgtgcagatcgtcgcggttttcacttgggttttcaaacaagtttcagggagaaagaaggaggcaaaaaaaaaaaatccaattatgcaaatggactccggactgggaggcgcgggatggatctgacgccgctactgtacgagttctcggagcagccccgggccgggcagatttatgggggcgcgtcacggctacgccaggtcccgccgccggagcatctcgaagttaattaaagcggtgctagtggagaggttaaactgctggagaactgtagtttccatcccagcaccaaaagaacagagtccagagttttcaggggccaccaagaggagccagagaagggtgccaacacagtccgtggc

SEQ ID NO: 284107 - DNA, 636 bp, Homo sapiens
gagaacaacggaggcagaggagctgaagactccagtatgcaactgactacaaggagacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcata

SEQ ID NO: 284108 - DNA, 2163 bp, Homo sapiens
gagaacaacggaggcagaggagctgaagactccagtatgcaactgactacaaggaggtagtcgtttgaaaagctttctttccttctctgaactccttctttccctcctctcaggtcattgggtgaccccgggccgggcggagacaggtgaatcccaagagaggaggaagagggagggacagatgatggagggagaaccgcgtttaggcaatgaatgagcctgctgcatccgcaccacctgttccttccaagggtgccaccccgacctgccagcagggttcccacaccaaccgggccgcgactcctgccggtgtcgcccacttgcccgccaaaggccgggcctcttctcccccagatcggggagaatgagaaccggcagtctagaagccgggaggtcggggcctagtccggaaccagggcctcaagcgtggggatggaatgaagaagcctgtggtccctggcgcgcgggccatagtaggaaccacagagagggagcaaagcaatgcattcggcctgacgagagctatgaaggcggggtcccgggcgggagtggctcagtgcccgccgggccgaggttaggggtgacaggcccggttaccggctaaatcctccccaccgcttgcccggagcctcacacttaccaagatccgcttgaagagcgcattctccttgggcgggaggctcacggccggcatcgttccggctgctcccgctgctcccgccaccacccggctcggtcagtcagtttgtccgaccgccgccgctgccgttccgtagctgcttcagccttgaatatctcgatccgccgccaccaccaggcctcgggtgtcgccgcgttgccctacccggacacctcctttttcctcgttgtcttttttcctttctcacttaacgctgccgccgcctcccccactacgggtctccgtcggcggttcacgtggtaactgaacagaccgacagaggcagccaaaatggcggacgcggagggttttcccacccgggtcacgcttcctaacacgcaggcgcggtgacctcctttccccacctcctctgggtttcggagcttgccgggaaacctggaggctggcctgcctgtggaggccgggagggtcggggcaggccccgcccatcatttcagtgcgtggtgccctcgaagcgcccgcggagctacgggaggctaggcaagtacggttcagaccgcctcctcatcaaaaacagcctctctggcgccttcctgctagatcgacctttcattccttggaaagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatgtaagtcatttcattaacagctgaccgtaaaactttttcaaagtggcattccattgatctaaaaattttcaagttatatgagccacttttaacctttggtttttgattacctctttccaaatcctgatttcactctgtagcattctttgcatcatgaattattaaacaatatgtgcgtgttttttactgttttaaatttatttgcaaagatattttaattttcaaacttctcttaactgtccctgaaaggtgtgagttgagatacatgtttcccaatataaacttgggttttg

SEQ ID NO: 284109 - DNA, 2509 bp, Homo sapiens
gagaacaacggaggcagaggagctgaagactccagtatgcaactgactacaaggaggtagtcgtttgaaaagctttctttccttctctgaactccttctttccctcctctcaggtcattgggtgaccccgggccgggcggagacaggtgaatcccaagagaggaggaagagggagggacagatgatggagggagaaccgcgtttaggcaatgaatgagcctgctgcatccgcaccacctgttccttccaagggtgccaccccgacctgccagcagggttcccacaccaaccgggccgcgactcctgccggtgtcgcccacttgcccgccaaaggccgggcctcttctcccccagatcggggagaatgagaaccggcagtctagaagccgggaggtcggggcctagtccggaaccagggcctcaagcgtggggatggaatgaagaagcctgtggtccctggcgcgcgggccatagtaggaaccacagagagggagcaaagcaatgcattcggcctgacgagagctatgaaggcggggtcccgggcgggagtggctcagtgcccgccgggccgaggttaggggtgacaggcccggttaccggctaaatcctccccaccgcttgcccggagcctcacacttaccaagatccgcttgaagagcgcattctccttgggcgggaggctcacggccggcatcgttccggctgctcccgctgctcccgccaccacccggctcggtcagtcagtttgtccgaccgccgccgctgccgttccgtagctgcttcagccttgaatatctcgatccgccgccaccaccaggcctcgggtgtcgccgcgttgccctacccggacacctcctttttcctcgttgtcttttttcctttctcacttaacgctgccgccgcctcccccactacgggtctccgtcggcggttcacgtggtaactgaacagaccgacagaggcagccaaaatggcggacgcggagggttttcccacccgggtcacgcttcctaacacgcaggcgcggtgacctcctttccccacctcctctgggtttcggagcttgccgggaaacctggaggctggcctgcctgtggaggccgggagggtcggggcaggccccgcccatcatttcagtgcgtggtgccctcgaagcgcccgcggagctacgggaggctaggcaagtacggttcagaccgcctcctcatcaaaaacagcctctctggcgccttcctgctagatcgacctttcattccttggaaagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatatgcagtttcacatacagctgggtactccaagtgtacagttcccatcagctctaatatgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcata

SEQ ID NO: 284110 - DNA, 1093 bp, Homo sapiens
gtggatcccggggtgctgtgacggaattggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcata

SEQ ID NO: 284111 - DNA, 1760 bp, Homo sapiens
gagaacaacggaggcagaggagctgaagactccagtatgcaactgactacaaggaggtagtcgtttgaaaagctttctttccttctctgaactccttctttccctcctctcaggtcattgggtgaccccgggccgggcggagacaggtgaatcccaagagaggaggaagagggagggacagatgatggagggagaaccgcgtttaggcaatgaatgagcctgctgcatccgcaccacctgttccttccaagggtgccaccccgacctgccagcagggttcccacaccaaccgggccgcgactcctgccggtgtcgcccacttgcccgccaaaggccgggcctcttctcccccagatcggggagaatgagaaccggcagtctagaagccgggaggtcggggcctagtccggaaccagggcctcaagcgtggggatggaatgaagaagcctgtggtccctggcgcgcgggccatagtaggaaccacagagagggagcaaagcaatgcattcggcctgacgagagctatgaaggcggggtcccgggcgggagtggctcagtgcccgccgggccgaggttaggggtgacaggcccggttaccggctaaatcctccccaccgcttgcccggagcctcacacttaccaagatccgcttgaagagcgcattctccttgggcgggaggctcacggccggcatcgttccggctgctcccgctgctcccgccaccacccggctcggtcagtcagtttgtccgaccgccgccgctgccgttccgtagctgcttcagccttgaatatctcgatccgccgccaccaccaggcctcgggtgtcgccgcgttgccctacccggacacctcctttttcctcgttgtcttttttcctttctcacttaacgctgccgccgcctcccccactacgggtctccgtcggcggttcacgtggtaactgaacagaccgacagaggcagccaaaatggcggacgcggagggttttcccacccgggtcacgcttcctaacacgcaggcgcggtgacctcctttccccacctcctctgggtttcggagcttgccgggaaacctggaggctggcctgcctgtggaggccgggagggtcggggcaggccccgcccatcatttcagtgcgtggtgccctcgaagcgcccgcggagctacgggaggctagacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcata

SEQ ID NO: 284112 - DNA, 413 bp, Homo sapiens
  misc_feature (11)..(12): n is a, c, g, or t
gcccacgcccnnttttttgtgccccctttccgggtgtggtgcccccgcggtttccagagcgccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcata

SEQ ID NO: 284113 - DNA, 2348 bp, Homo sapiens
gagaacaacggaggcagaggagctgaagactccagtatgcaactgactacaaggaggtagtcgtttgaaaagctttctttccttctctgaactccttctttccctcctctcaggtcattgggtgaccccgggccgggcggagacaggtgaatcccaagagaggaggaagagggagggacagatgatggagggagaaccgcgtttaggcaatgaatgagcctgctgcatccgcaccacctgttccttccaagggtgccaccccgacctgccagcagggttcccacaccaaccgggccgcgactcctgccggtgtcgcccacttgcccgccaaaggccgggcctcttctcccccagatcggggagaatgagaaccggcagtctagaagccgggaggtcggggcctagtccggaaccagggcctcaagcgtggggatggaatgaagaagcctgtggtccctggcgcgcgggccatagtaggaaccacagagagggagcaaagcaatgcattcggcctgacgagagctatgaaggcggggtcccgggcgggagtggctcagtgcccgccgggccgaggttaggggtgacaggcccggttaccggctaaatcctccccaccgcttgcccggagcctcacacttaccaagatccgcttgaagagcgcattctccttgggcgggaggctcacggccggcatcgttccggctgctcccgctgctcccgccaccacccggctcggtcagtcagtttgtccgaccgccgccgctgccgttccgtagctgcttcagccttgaatatctcgatccgccgccaccaccaggcctcgggtgtcgccgcgttgccctacccggacacctcctttttcctcgttgtcttttttcctttctcacttaacgctgccgccgcctcccccactacgggtctccgtcggcggttcacgtggtaactgaacagaccgacagaggcagccaaaatggcggacgcggagggttttcccacccgggtcacgcttcctaacacgcaggcgcggtgacctcctttccccacctcctctgggtttcggagcttgccgggaaacctggaggctggcctgcctgtggaggccgggagggtcggggcaggccccgcccatcatttcagtgcgtggtgccctcgaagcgcccgcggagctacgggaggctaggcaagtacggttcagaccgcctcctcatcaaaaacagcctctctggcgccttcctgctagatcgacctttcattccttggaaagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttgtaagctggagctgtaacacgggccgagctcgatga

SEQ ID NO: 284114 - DNA, 446 bp, Homo sapiens
ggccctcggggcccaaggaattcgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcata

SEQ ID NO: 284115 - DNA, 2450 bp, Homo sapiens
gagaacaacggaggcagaggagctgaagactccagtatgcaactgactacaaggaggtagtcgtttgaaaagctttctttccttctctgaactccttctttccctcctctcaggtcattgggtgaccccgggccgggcggagacaggtgaatcccaagagaggaggaagagggagggacagatgatggagggagaaccgcgtttaggcaatgaatgagcctgctgcatccgcaccacctgttccttccaagggtgccaccccgacctgccagcagggttcccacaccaaccgggccgcgactcctgccggtgtcgcccacttgcccgccaaaggccgggcctcttctcccccagatcggggagaatgagaaccggcagtctagaagccgggaggtcggggcctagtccggaaccagggcctcaagcgtggggatggaatgaagaagcctgtggtccctggcgcgcgggccatagtaggaaccacagagagggagcaaagcaatgcattcggcctgacgagagctatgaaggcggggtcccgggcgggagtggctcagtgcccgccgggccgaggttaggggtgacaggcccggttaccggctaaatcctccccaccgcttgcccggagcctcacacttaccaagatccgcttgaagagcgcattctccttgggcgggaggctcacggccggcatcgttccggctgctcccgctgctcccgccaccacccggctcggtcagtcagtttgtccgaccgccgccgctgccgttccgtagctgcttcagccttgaatatctcgatccgccgccaccaccaggcctcgggtgtcgccgcgttgccctacccggacacctcctttttcctcgttgtcttttttcctttctcacttaacgctgccgccgcctcccccactacgggtctccgtcggcggttcacgtggtaactgaacagaccgacagaggcagccaaaatggcggacgcggagggttttcccacccgggtcacgcttcctaacacgcaggcgcggtgacctcctttccccacctcctctgggtttcggagcttgccgggaaacctggaggctggcctgcctgtggaggccgggagggtcggggcaggccccgcccatcatttcagtgcgtggtgccctcgaagcgcccgcggagctacgggaggctaggcaagtacggttcagaccgcctcctcatcaaaaacagcctctctggcgccttcctgctagatcgacctttcattccttggaaagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcata

SEQ ID NO: 284116 - DNA, 2088 bp, Homo sapiens
gagaacaacggaggcagaggagctgaagactccagtatgcaactgactacaaggaggtagtcgtttgaaaagctttctttccttctctgaactccttctttccctcctctcaggtcattgggtgaccccgggccgggcggagacaggtgaatcccaagagaggaggaagagggagggacagatgatggagggagaaccgcgtttaggcaatgaatgagcctgctgcatccgcaccacctgttccttccaagggtgccaccccgacctgccagcagggttcccacaccaaccgggccgcgactcctgccggtgtcgcccacttgcccgccaaaggccgggcctcttctcccccagatcggggagaatgagaaccggcagtctagaagccgggaggtcggggcctagtccggaaccagggcctcaagcgtggggatggaatgaagaagcctgtggtccctggcgcgcgggccatagtaggaaccacagagagggagcaaagcaatgcattcggcctgacgagagctatgaaggcggggtcccgggcgggagtggctcagtgcccgccgggccgaggttaggggtgacaggcccggttaccggctaaatcctccccaccgcttgcccggagcctcacacttaccaagatccgcttgaagagcgcattctccttgggcgggaggctcacggccggcatcgttccggctgctcccgctgctcccgccaccacccggctcggtcagtcagtttgtccgaccgccgccgctgccgttccgtagctgcttcagccttgaatatctcgatccgccgccaccaccaggcctcgggtgtcgccgcgttgccctacccggacacctcctttttcctcgttgtcttttttcctttctcacttaacgctgccgccgcctcccccactacgggtctccgtcggcggttcacgtggtaactgaacagaccgacagaggcagccaaaatggcggacgcggagggttttcccacccgggtcacgcttcctaacacgcaggcgcggtgacctcctttccccacctcctctgggtttcggagcttgccgggaaacctggaggctggcctgcctgtggaggccgggagggtcggggcaggccccgcccatcatttcagtgcgtggtgccctcgaagcgcccgcggagctacgggaggctaggcaagtacggttcagaccgcctcctcatcaaaaacagcctctctggcgccttcctgctagatcgacctttcattccttggaaagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcata

SEQ ID NO: 284117 - DNA, 3051 bp, Homo sapiens
gagaacaacggaggcagaggagctgaagactccagtatgcaactgactacaaggaggtagtcgtttgaaaagctttctttccttctctgaactccttctttccctcctctcaggtcattgggtgaccccgggccgggcggagacaggtgaatcccaagagaggaggaagagggagggacagatgatggagggagaaccgcgtttaggcaatgaatgagcctgctgcatccgcaccacctgttccttccaagggtgccaccccgacctgccagcagggttcccacaccaaccgggccgcgactcctgccggtgtcgcccacttgcccgccaaaggccgggcctcttctcccccagatcggggagaatgagaaccggcagtctagaagccgggaggtcggggcctagtccggaaccagggcctcaagcgtggggatggaatgaagaagcctgtggtccctggcgcgcgggccatagtaggaaccacagagagggagcaaagcaatgcattcggcctgacgagagctatgaaggcggggtcccgggcgggagtggctcagtgcccgccgggccgaggttaggggtgacaggcccggttaccggctaaatcctccccaccgcttgcccggagcctcacacttaccaagatccgcttgaagagcgcattctccttgggcgggaggctcacggccggcatcgttccggctgctcccgctgctcccgccaccacccggctcggtcagtcagtttgtccgaccgccgccgctgccgttccgtagctgcttcagccttgaatatctcgatccgccgccaccaccaggcctcgggtgtcgccgcgttgccctacccggacacctcctttttcctcgttgtcttttttcctttctcacttaacgctgccgccgcctcccccactacgggtctccgtcggcggttcacgtggtaactgaacagaccgacagaggcagccaaaatggcggacgcggagggttttcccacccgggtcacgcttcctaacacgcaggcgcggtgacctcctttccccacctcctctgggtttcggagcttgccgggaaacctggaggctggcctgcctgtggaggccgggagggtcggggcaggccccgcccatcatttcagtgcgtggtgccctcgaagcgcccgcggagctacgggaggctaggcaagtacggttcagaccgcctcctcatcaaaaacagcctctctggcgccttcctgctagatcgacctttcattccttggaaagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcataaaaaaagaacaaaaaaaacaaaaaaaaacacaaacacacacaaccaccacaacacccaaaaccaaacagaaaaaaaaacacaaaaacaaacaaaaaaaacaacaacaaaagaacgaaaaagagcaaacaaaacgggaggggggggcggcggacgacgacacgacgtacacgcgccgcccgagggagcggaccgaccgcaccgagaggcgcggcacgcacggactacaggacgaggagcgacgagacaagcggaaggggcgggccacaagggcagagcgaagagagcgggagcagacagacggcgcagcggggcgggacagaaggaaagcacgcgaggcggcgcagcacacataacgcggcgcaccggccagaaacgcccgacgctagcgtgtgggaggcgcaccagcagggggagcgcaccacgcagaccgggactggtgacgagcacagaggccggcgcggggaggagcgcgcaagacacgccgcgcggcctgggactggtgcgatgcgcactcagagcacaacaggaacgaagcgctggccggggctgcgcgggtacacgacgacgtccgcaaggaggaacacactcacgagcgaggac

SEQ ID NO: 284118 - DNA, 1563 bp, Homo sapiens
tttgtgatgcagctcgccaggcctacggggaggtaaaggacttgccaggctgaagtaacttcagaagcagaaaaacggaggattaaaaccacaagtcgttgtgatgtgaaatttcgtggggcaagaaagggccggaagtaggtagtctgcacggctctgctagagagaggatcacaagatcacacaaatgtgatctacttatgactggaaaaaatgtgtactttcagagccagcttgaggcattccattgcctccaatatgagctcttcccttcaagattgactataaatctcttagttacaactcacatcccctttccccagacaaaaccccacatagcccggtgtgtatttactgaaagcagtaagatactgctggggctttgggtgcaagatggagagtgctcagagataatgacaggggcctggtcctgcagggccttacgtagaaagtcaaggaatttattctctgagcaattgaaaatcatcccgaaagatctgcattttagaaataccatgttgagtagttgcataagaaaccagttaggaggcccctttttattggaggtagagaataatgagagactgaactacagaagtggggaaggaagacagctgtagatccaagaaatagtatccggaagagaggcttgagaagtgatcaaggagaattccacagttatcagagaccctgtcttccttgttcaccactatattaccagaacataatacaaataatgctattgttattgggtggcattatttggttagtaggtactttttaaaatttttaaatttaattttagtattaaaatacatgtaaagatcaggaaaatgaacttttaaaaataaagggctttcactgggcatgataacacatccctgtagtcccagctactcccagctattcaggaggctgaggcggcaggatcacttgaaccaaggagttcaagtttagcctgggcagtatagtgaaaccctttctcaaaaacaaataaagggctactgaaataatgataatttatattcaggtcgtaggtacctaattactagttacacatacatggctttgatgggaaatcaaagaaacattctgacaatacagagattcatcaagcaatttgtctttgaaagttgattattcaaaaacagagcttgtagcaaaagaagcagaagttagatcccacagtcatcaagtttcagatcctaaggcttgcattcttacaccaatttcttctttgcttaaatcttaattttcatcagcattaattaagtgtctgggtactctgccagtcaggagagatgttaccaaaggtacaggatttgagaagtattgtcagaagagccaagttcataatcaggcccataggatcaataatttgggggagtgtttagagcagtttcaaagatgagagcagtagatcaaagtagaatttcaggactgagcacatgccaaggcacccttttatggatattcaacctgtaccagaagggaggagtcatttacttaaaagagttacacaagatgaaagagctagatccaaataaagacgctataaaaatt

SEQ ID NO: 284119 - DNA, 787 bp, Homo sapiens
  misc_feature (555)..(555): n is a, c, g, or t
acaggtgattattgtgccaatatccgtaataaccctgtatccagaagagaattgtacctgtgaatgaaatgcatccgttccaagtagacacagccttttgaaatatctacacacaggtctacaaggtcaaccaagcgaaggagacgaagccctggaagctgtttttggcaaccaccaggaaaggctgcggaacagctgaagtgaatgtgagaaccaatctttataagcattaggatcctgggtgactcaaaacgatctggaaaaagtagatccactttttttttcagtccatcctttttcatcctctcttcacttttcatacccccagccccaccacaaaacaagacaaatctacaaataaaatttattgtttaagatgaaaaaaacaaacattgagtatctattgcatatcttgccttaacatttttatatttctgtcgttgatttgtagaaacaattctcggttatagtctatcttactgccgctggttatgggttgtaatttgtatcgtgtcattttcgaatacgtagtgtaagtgccgtcagacagtattncctctttccgtcctaatttaattttactactcttattttgtttcggcaattttctcaaggtgcactgctattcttttcatctgctacggtgcgctcatgaatatgtagggtatatatcgaaatagtcttaataatatgcctagcgtctatttgatgatgtcatcatatacatctctcattatatactaaacccacttgtattagttcgagtctatcaatttttaacgctgtg

SEQ ID NO: 284120 - DNA, 2162 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284121 - DNA, 905 bp, Homo sapiens
ccctctttttagaaaggaaaccaaaaagcagggggttcaggtcccccaagggttggttttcgggcttggaacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284122 - DNA, 2109 bp, Homo sapiens
cttgtgggacatcgtcgacccacgccgctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284123 - DNA, 2843 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctaaaaaaacacaaaaaaaaaaaaaaaaaaaaaaaaaaaaaaaaaaaaaaaaaaaaaaaaaaaaaaaaaaaaaaaaaaaaaaaaaaaagaggggggggcgcgcgcagcacaaagctcatcctctccgcggggggcgcccgcagaacgcgagcggaccccagacgtatggggaacacagggagcgccccaattggggcgcgctctttattattcaccacgtggacgaggtggtcgagtgcgagaacaataaaccaaaccgaatgtcagggaggagaaatccgtctgcgtcactaccgcggcgcgcatctctggcgagatcaagacagccccacctcctcatgcgcgggggctagtgaccaaccatcattgtggtggggccacccacctacaactacctcctacacatgcccttatctcatccgcgacaccactcatctacgcgtgcggagaccacataacacaacaacacatacaagaggagcgatgttaagcgagtgtgacctctcaaccacccacccgacgaaatgactattactgcgcccagcccgtcctgctacgaagacattcctccgccaccacgagccaaccacaacaccatccctaaaacaaaacatttatattccaaacccccgcaaacttacaccattcactcacacacccccatccaacaaacccacccacaccccacctaccacacaaccaccacctcacaaaccaccaaacacacacaaccaccccccaaccaatcacccacccccccctccacatcccatccacactgggcggcggacggcgacgtagggtgggggtcgggacgaagagaggacgcacggggtgcggcgagcagtaggcggcacgcgcggatgcgaacggaggaagagagacctcaggagtagctagagggggcgaggatgcgcagcaagggcagccgacgaaacgacgggaagcgaacgcgggcgctgctaaggcgaggcctgtcgcgacagggagccaataccaaatgtacttcactccaacacacatcctcatcttaccacgcaccatactcagtcagcacgaataacgccgccactccgacctccgtcggcctcactaccagccaacactacaaaaaatacccaagcgcccaaaaagtcgcacacatccaacacaatatccaaaaatattcacataaacatcttcaccatacaacaacaacgccacgtaacaacaacataacacaaacgcattatacactaacattactatcctacatcccatacgcacatcaacacaccatgaacaccacgacattacaccaatctcagacatacccaccatactatcagcatgacacatcacacaccacataactacattcaacacc

SEQ ID NO: 284124 - DNA, 1139 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcatgtacgcttggggtagcgagctcgaat

SEQ ID NO: 284125 - DNA, 2142 bp, Homo sapiens
cttgtgggacatcgtcgacccacgccgctgccggagggcgggaggcaggagcgggccaggagctgctgggctggagcggcggcgccgccatgtccgacagcgagaagctcaacctggactcgatcatcgggcgcctgctggaagggtccagggtcctgacaccccattgcgccccagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284126 - DNA, 2361 bp, Homo sapiens
ctgcccccccgcggacgcgcctgagaggtccggggccagctccgacgcgcggagcagctccccccctctcccgggctgggggcgcacgggttgcctgggctcttggggcgagggagaaacccgggaagcccggtccaggaaggggtcctgcgctgtgaggtttttggtggcagccccctgcgcacgacagtcgcctcccgaggcgctgagggtagctgggggcttcccctgggaggcttgaggccgcggtcccgggaggctcagcagcaacagctgcctgtgggcaaggaggggccgaggaggcctaggcgcccccggaggtatccatggggccacccgtgtcgcccaccctcctcctgtcagggtccagggtcctgacaccccattgcgccccagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284127 - DNA, 2030 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaaggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284128 - DNA, 2245 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtgggctggtggctccggcctgcggcaggggaaggggagggccgtgcctgcgctcgggactgactgctcccatcctcgcccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284129 - DNA, 2058 bp, Homo sapiens
cttgtgggacatcgtcgacccacgccgctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284130 - DNA, 1796 bp, Homo sapiens
cgactacaagtagtgagccgggttaatcggcacaggctactcttctgtctttctctctctctctctctctctctctctctctctcatctgcctttgtctgtctattacgactcagtatctctataacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284131 - DNA, 1641 bp, Homo sapiens
ccgggtgttaatcggacgaggatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284132 - DNA, 2057 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284133 - DNA, 934 bp, Homo sapiens
  misc_feature (895)..(895): n is a, c, g, or t
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggggtgnagcggtccgttcttgcccccgcgccctgtgccctttcca

SEQ ID NO: 284134 - DNA, 655 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgtgagtggtctgagcgtctggggctgcccgggtcctgaaccgcactctttgccattcagtgggaccttcacattggcctgatatctgacagacac

SEQ ID NO: 284135 - DNA, 417 bp, Homo sapiens
aagacggctacgagttctttgccaagcggcagctggtgacacttttctcagctcccaactactgtggcgagtttgacaatgctggcgccatgatgagtgtggacgagaccctcatgtgctctttccaggtgagtgtggggaagaaaggagccgctaggccctgtggctcagccccatgagcctgaccaacactgtctcttttagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtca

SEQ ID NO: 284136 - DNA, 450 bp, Homo sapiens
catcggtgcctgactctctcctcccagccacggctgaatagcccagggaccctggctgagggtggggtaggcaggcacctcacagccacctccccctgggcaggcaagagacgctacaacatcaaactgtggaaaaccttcactgactgcttcaactgcctgcccatcgcggccatagtggacgaaaagatcttctgctgccacggaggtgagggaggggatggctggggaggaggagcactggccgcatccctcagcacccggcagctctccttaggtctcatctgggaagtcactccttccaggaagtgtcccccataccccactgtgctgggctgcactcacttccttgatgtgtgtcctacatggagtgggcttgtctcctttctcccgggagctctgtgctcctgagggcagggatgcctttgtgcctgtttgggaacttgaaaa

SEQ ID NO: 284137 - DNA, 1479 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagct

SEQ ID NO: 284138 - DNA, 1393 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggcaacccatctggtctcttgaataaaggtcaaagct

SEQ ID NO: 284139 - DNA, 2122 bp, Homo sapiens
  misc_feature (112)..(112): n is a, c, g, or t
cccatagcttaggcttcgaggccctccgattttatgctgggcgtgaggcagtgcagcccggcctggtatgctgctgggcgtggagcggcggcgcccgtccatgtccgacagncgagaatgctcaatctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284140 - DNA, 2303 bp, Homo sapiens
caccctactttcgggacctgtgcgtgaggagctatgcctgttgaggctgctggcattcaggcagaaatttggcctggagcagctgccatgaggcaagagctgggcctggaaaaagcccctgggaggcaagagcagggcctgcagaggctgttctcaagtcaaagctgggcctgttcatgccactgggaagcagaaggtgggcctggagagtttgacttgaggaagttttgggcctacattggccgccatgagctggacaggaactgggccaaaaaaggctgttgtgaggcagcagttgtgcctgtagacccagccaagaggaagaggtgggcctggagaagcccccatgaggtagaggttgggcctgtagacgctgacaggaggcaggagctgcgcctggaaaggtcaacttgaggagattttgcgccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284141 - DNA, 1295 bp, Homo sapiens
ggccccgggaagctaggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagct

SEQ ID NO: 284142 - DNA, 1644 bp, Homo sapiens
ggtcgggctgatctagaggatcccttcgattgtgggactcaggcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284143 - DNA, 1591 bp, Homo sapiens
ccacgcgtacgccacgcgtcgaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284144 - DNA, 1407 bp, Homo sapiens
gctgtgggtgatcgtggcagtgggtagaccgtggctagtgggtagagcgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggg

SEQ ID NO: 284145 - DNA, 483 bp, Homo sapiens
cacggaaatagccaacccttttcttccgcacggttggaggaggtcggctggttatcgggagttggagggctgaggtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacag

SEQ ID NO: 284146 - DNA, 992 bp, Homo sapiens
ttattagttcaagaaaaggcatacacatttattcaacatgtatacctggggagaaccagtcattaccccgatgttcattattttgatcaccacgatagagctgactactctgctatgtagtgcattttgggactgcacttatgtatgtttttgtttaacgtggacaaagacttacagataggtgcaaaaaataaatcctcttttgcaacccagaactcattgttcagtatgagttttgatacatataagaagggatattatgatacctgagacagttgattgatgggagtattgatagccataaaggttggttccaggccaggtgcaatgggtcaagcctgcaatccccacaccaaggtgggagtattgcttgaaaccaggagttcaagaccagcctaggcaagaaagcttttatcttgagaacatggtgtctggagttaaagataatctacttttttaccttaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttca

SEQ ID NO: 284147 - DNA, 429 bp, Homo sapiens
tagaataagtggagaaatgttggtagatataagatgtgagatgatagtataggatggtggaaggggtgacgattgaatgagatgggagatcccagccacgtacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284148 - DNA, 420 bp, Homo sapiens
cttcctttcaccagcaccaaggggccctgtcccacaatccccaacctccctcggcagaggggtcttcaaccaatcagaggagagaagaggaccgagaaaggggaaagggagaaaaaaaaaaaaaaaagcaaagctttgtatggtataaaaggtttgtgtccccaggctccctcccccaatcccttaaaacaagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284149 - DNA, 358 bp, Homo sapiens
attcacgatggcccctgggactccccgggctattaagcccctggccacaatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaaggcaaacttgaagataatcttttactctctggatcatcacggatcctc

SEQ ID NO: 284150 - DNA, 2312 bp, Homo sapiens
cacggaaatagccaacccttttcttccgcacggttggaggaggtcggctggttatcgggagttggagggctgaggtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaagtaatggtttttatcttaactataagttatttgctcaagggtgtaatggtcattaccaaggcttttagaatgcagtttctcatttgctgtggacatgaccataaaaaaatttcccagtaggttttctatctgctacgttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccctatagcactcctaatgtttggtgctatgttttcctgaggagatataaaacgtaataatccatgattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttca

SEQ ID NO: 284151 - DNA, 913 bp, Homo sapiens
ttattagttcaagaaaaggcatacacatttattcaacatgtatacctggggagaaccagtcattaccccgatgttcattattttgatcaccacgatagagctgactactctgctatgtagtgcattttgggactgcacttatgtatgtttttgtttaacgtggacaaagacttacagataggtgcaaaaaataaatcctcttttgcaacccagaactcattgttcagtatgagttttgatacatataagaagggatattatgatacctgagacagttgattgatgggagtattgatagccataaaggttggttccaggccaggtgcaatgggtcaagcctgcaatccccacaccaaggtgggagtattgcttgaaaccaggagttcaagaccagcctaggcaagaaagcttttatcttgagaacatggtgtctggagttaaagataatctacttttttaccttaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284152 - DNA, 383 bp, Homo sapiens
tacttggggtgccgggtttcaggatactttggaacctaagcaacctcattcttgaaagatagatttatgtacttaatagtaaatataaatttgaaatacacatttttccacaggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284153 - DNA, 1231 bp, Homo sapiens
gtattttataatggatgacaattaattttgagccaagaattaaaatttgctgaaatcttcgaattgggaaaacaacatcctctgttgcatactgaagttcataacaacagttagactttaaacttaaatcttaagtttaaatctttttcctttggttcatgtaaaggagctacttgatgttactttttatttatcattcctctggctcctaagcacaacgtgattgtgaaattattgtttttgtgattaacgtagtaggaagtttctgcagttggcaatattgtaagagcatattgcagtttctgctcataatttctttcctatggagtgttagactttgttatttatgtgtataaatactagctggacacagtggtgcctgtggtccccagctactctggaggctaaggcaggagaaacacttgagcccagcggtttgaggctacagtgagatgtgatcctgccacatctcactgtagcatcgaacccctgggctcaagtgattcagcaagaatcacacgatttttaaaagacatggcagatcctgtgtctttaaaaaaaaatcaaaaccttgtaaatagtggttgaggtctatcccgatggggcttttcctgtagcctgcacatcgttggaaacgcctcatagagtaactctgtggttttactttactcacaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284154 - DNA, 1596 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaagataatctacttttttaccttaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284155 - DNA, 1574 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284156 - DNA, 2510 bp, Homo sapiens
aagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284157 - DNA, 2676 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttca

SEQ ID NO: 284158 - DNA, 3345 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaagtaatggtttttatcttaactataagttatttgctcaagggtgtaatggtcattaccaaggcttttagaatgcagtttctcatttgctgtggacatgaccataaaaaaatttcccagtaggttttctatctgctacgttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccctatagcactcctaatgtttggtgctatgttttcctgaggagatataaaacgtaataatccatgattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttca

SEQ ID NO: 284159 - DNA, 2043 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacgcttttatcttgagaacatggtgtctggagttaaaggtattggcatactccacacatctgtaccattcttgagtgatcgcttaggaatgaatgtgatttgaactcattcatgttgagagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaagtaatggtttttatcttaactataagttatttgctcaagggtgtaatggtcattaccaaggcttttagaatgcagtttctcatttgctgtggacatgaccataaaaaaatttcccagtaggttttctatctgctacgttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccctatagcactcctaatgtttggtgctatgttttcctgaggagatataaaacgtaataatccatgattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284160 - DNA, 1221 bp, Homo sapiens
cggtacccagttcgacggagactctcgaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284161 - DNA, 3632 bp, Homo sapiens
  misc_feature (3632)..(3632): n is a, c, g, or t
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaagtaatggtttttatcttaactataagttatttgctcaagggtgtaatggtcattaccaaggcttttagaatgcagtttctcatttgctgtggacatgaccataaaaaaatttcccagtaggttttctatctgctacgttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccctatagcactcctaatgtttggtgctatgttttcctgaggagatataaaacgtaataatccatgattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcgcgcgccgcgcgcgacagaaaagagaacacaaacacaaaaggaggggaagagcagacacagagaagagaaaagaagaagagagaaagaggtgaaagagaagacagaggagagaaagagagggcggaggcacacacaagaaaaaaaaagcgcgggagagcaacaagaggagtaagaaaccacccacaagaggagacaagagagacagcgcgaagcaacacaaaaggaggacaagcagaggggaaataaaaaaacgn

SEQ ID NO: 284162 - DNA, 1631 bp, Homo sapiens
ttagaggatccacactgaagactgtcagaatcatcctccatcactagatcttctccaccagtcatgttccctgagcagtggggtggcttgaaggtataaaccagagaggcccaagggagggatagttagcagacttctggtctttttctagtttgtgctcttcttctaagtatacactcagtcttacaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284163 - DNA, 3114 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaagtaatggtttttatcttaactataagttatttgctcaagggtgtaatggtcattaccaaggcttttagaatgcagtttctcatttgctgtggacatgaccataaaaaaatttcccagtaggttttctatctgctacgttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttca

SEQ ID NO: 284164 - DNA, 3035 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaagtaatggtttttatcttaactataagttatttgctcaagggtgtaatggtcattaccaaggcttttagaatgcagtttctcatttgctgtggacatgaccataaaaaaatttcccagtaggttttctatctgctacgttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284165 - DNA, 1653 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttca

SEQ ID NO: 284166 - DNA, 1491 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagagggtgtcaaattgagaaccaggtagatccccaccacctacagtaaaaaggtgaattttgaagtcttcatcagtatatccatattaaaacgagatgacagaagccaaagtaattatgggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284167 - DNA, 1298 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggtgaagcatatagaaaaaacgacttcatagaaatgaataaagataaatgtggatatatgtaccagtctggtggtgaagaaattctgaaacccagaactttataacaagaaaaaaaatttttaaccctgtgaagaagtttgtgaaagaaacttgtgaagtagtaataattagaaaaaaaaccattaaaacaccagagaaaatacataga

SEQ ID NO: 284168 - DNA, 1560 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaagataatctacttttttaccttaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284169 - DNA, 1019 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacgtaagtggaatcatatgaaatactttggtaataggttataaattaaatttctatgttaattgcttcatattttgcctttaatatagttatacttaaataatgaacaaagatacagagtatgacaattgggattattacagttgagccaagc

SEQ ID NO: 284170 - DNA, 478 bp, Homo sapiens
attcacgatggcccctgggactccccgggctattaagcccctggccacaatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284171 - DNA, 373 bp, Homo sapiens
caatattagaaataacatttaataaggaattttcagctcttataggaccactttttttatgtgctgtatattgactgaaacattgtaatgtggtatacattactgtgtcttggatcaggtgtcaaaatgtaactgtactttgtacaattcaacttctaggaccctaaagtaaattggttgaagaaattagatcccaaagattcttggtaagttaattcattacttaaaaggccatgcaggttattttgttgaatactagcttttctccaaatgttattttaggttatttatttatctagcaatgctatgcaacatctatcaccacttaggagtaaaaaaaaggactaggcttacgttattatgtgtttaaact

SEQ ID NO: 284172 - DNA, 1672 bp, Homo sapiens
cacggaaatagccaacccttttcttccgcacggttggaggaggtcggctggttatcgggagttggagggctgaggtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284173 - DNA, 2597 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284174 - DNA, 3266 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaagtaatggtttttatcttaactataagttatttgctcaagggtgtaatggtcattaccaaggcttttagaatgcagtttctcatttgctgtggacatgaccataaaaaaatttcccagtaggttttctatctgctacgttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccctatagcactcctaatgtttggtgctatgttttcctgaggagatataaaacgtaataatccatgattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284175 - DNA, 3051 bp, Homo sapiens
  misc_feature (2687)..(2687): n is a, c, g, or t
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcaataaaaaacanaacaaacaacacgaaacacgaaaaacaatctgttgtgcggcgcccctgggccccttgagagaaaactttttagaaccccttttgcgttgtggcggcccgggggccccacagttgggtttaggtgggcacccttgtgtctacaagtggtgtctccccaagagagagaacacctccggggtcaagcggacaacaagagtgcgtcgtgaggactcttcacccaaagtatataaaacccgccccgcgggggaaccaccggccgcttttctgtagacacaacccccacagtgggaacctctgagggcgcacacacagggcgagccttatcaacaaggggtgcccaacagaaaccccgagttaaaaatcg

SEQ ID NO: 284176 - DNA, 2881 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatggaattcttttgcccttgctctgttttgggcataagcttcttgttttgttttttcttccttttgttgtttcacttcagctagttgattgtataacctgtaaagaatttatatagaattagagacaaacactgcaaaaagtgaatcac

SEQ ID NO: 284177 - DNA, 3550 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaagtaatggtttttatcttaactataagttatttgctcaagggtgtaatggtcattaccaaggcttttagaatgcagtttctcatttgctgtggacatgaccataaaaaaatttcccagtaggttttctatctgctacgttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccctatagcactcctaatgtttggtgctatgttttcctgaggagatataaaacgtaataatccatgattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatggaattcttttgcccttgctctgttttgggcataagcttcttgttttgttttttcttccttttgttgtttcacttcagctagttgattgtataacctgtaaagaatttatatagaattagagacaaacactgcaaaaagtgaatcac

SEQ ID NO: 284178 - DNA, 2595 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatgcatcatacggggatcgctctagag

SEQ ID NO: 284179 - DNA, 1538 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284180 - DNA, 1664 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggtgaagcatatagaaaaaacgacttcatagaaatgaataaagataaatgtggatatatgtaccagtctggtggtgaagaaattctgaaacccagaactttataacaagaaaaaaaatttttaaccctgtgaagaagtttgtgaaagaaacttgtgaagtagtaataattagaaaaaaaaccattaaaacaccagagaaaatacatagaaaaatttgagaaattgtcatttgatttctgaataagagcttacaggtgtcctgtgagtattgaaacaatgaaatgtagtgattttaattttgaaaagaaaatcttaaagtaacttgacacccaaccatcttgaagaggggatttgaaatgctgtaattttatcccagctttgttcagccatgacaagtgacctgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcct

SEQ ID NO: 284181 - DNA, 1329 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaagggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 284182 - DNA, 493 bp, Homo sapiens
tggaggtgattggattaacaattttattctgcatccactacaaaagggctggtgttttgttccaaatgtttagctgggagggctgtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacag

SEQ ID NO: 284183 - DNA, 1813 bp, Homo sapiens
ccattttatagataggcaggcagagaaagatgaattgcttgcttttcttttgggaacctggattcttttaatagttgttgaagcctccagggggccaggcggatcacttgaggcccagcctggccaacatagcgaaaccctgcctctactaaaaccacaaaaatcagccgggtatggtggcacacgcttataatcccagctatttgggacgctgaggtgggatatagcttgaacccgggaaggagactgcagtcagggaagcctagggaagcctcagaccaaggatgattgaataacaaagaaaaggtgtaagtaaagatctccaactcttagggagtactaattaggaaagttaagggtagaaaaagataaattaaggaaaataccgttgagatgctaatgggttaatttcagagaaaaaagactgagtagagggggtatggggaatgtgtgctggggagggagtgtgacgaaggtcgtaaagagacccttgctcaacgtcagttgacgttctgactgtggggaggtcgaaaactcggaagggcctgagggaaggaatgggcagtaccacgttctgacacctaggtcagtatggcgggggaagagtaaagaagacaaggaccgagaccctgccatgtcagtacctttctcttacggaggggcaccgccctgttggggtccacagccaaccccatctcggccaggttctgccgtaccgatttagcgtggtcccaggcatgtcggatgtgggagctaccggcaaagagagacatcgcggatccgtcatctcgcggaccgtcccggccgaggcccacggccacccggaaccccagccccctcaccattcgatccgcggcgctgccttccgtcgagcattccggttcagacgctttcggttgacactgtaaccaaacttctgcctccgggttttgcccttggccttgggcatcgcgctgaccaccgcaccagcagctcaaacacgctgcctctgtctctcagacctcgtgtaacaaactccttccggaaggcgtgcacaaggctttgcgggcatttggggaaatgtagtccttttgtagcactaccgtgctgagcactacgactcccaggatgcaacgagcatttgcgcctgcgtacaaggctcaatttattcgtttccccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagctccgcagaaatgattccaaaacccagggagcaaccactggccctaccgtgggacttactccctcctctcctttgagaggcccatgtgtcgctggggaggaagtgaccctttgtgtaactgtaaccgaaagttttttcaaaaatcctagatgctgttgtttgaatgttacatacttctatttgtgccacatctcccctccactcccctgcttaataaactctaaaaatccacttgtattta

SEQ ID NO: 284184 - DNA, 1866 bp, Homo sapiens
  misc_feature (1866)..(1866): n is a, c, g, or t
ccattttatagataggcaggcagagaaagatgaattgcttgcttttcttttgggaacctggattcttttaatagttgttgaagcctccagggggccaggcggatcacttgaggcccagcctggccaacatagcgaaaccctgcctctactaaaaccacaaaaatcagccgggtatggtggcacacgcttataatcccagctatttgggacgctgaggtgggatatagcttgaacccgggaaggagactgcagtcagggaagcctagggaagcctcagaccaaggatgattgaataacaaagaaaaggtgtaagtaaagatctccaactcttagggagtactaattaggaaagttaagggtagaaaaagataaattaaggaaaataccgttgagatgctaatgggttaatttcagagaaaaaagactgagtagagggggtatggggaatgtgtgctggggagggagtgtgacgaaggtcgtaaagagacccttgctcaacgtcagttgacgttctgactgtggggaggtcgaaaactcggaagggcctgagggaaggaatgggcagtaccacgttctgacacctaggtcagtatggcgggggaagagtaaagaagacaaggaccgagaccctgccatgtcagtacctttctcttacggaggggcaccgccctgttggggtccacagccaaccccatctcggccaggttctgccgtaccgatttagcgtggtcccaggcatgtcggatgtgggagctaccggcaaagagagacatcgcggatccgtcatctcgcggaccgtcccggccgaggcccacggccacccggaaccccagccccctcaccattcgatccgcggcgctgccttccgtcgagcattccggttcagacgctttcggttgacactgtaaccaaacttctgcctccgggttttgcccttggccttgggcatcgcgctgaccaccgcaccagcagctcaaacacgctgcctctgtctctcagacctcgtgtaacaaactccttccggaaggcgtgcacaaggctttgcgggcatttggggaaatgtagtccttttgtagcactaccgtgctgagcactacgactcccaggatgcaacgagcatttgcgcctgcgtacaaggctcaatttattcgtttccccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagctccgcagaaatgattccaaaacccagggagcaaccactggccctaccgtgggacttactccctcctctcctttgagaggcccatgtgtcgctggggaggaagtgaccctttgtgtaactgtaaccgaaagttttttcaaaaatcctagatgctgttgtttgaatgttacatacttctatttgtgccacatctcccctccactcccctgcttaataaactctaaaaatccacttgtatttacaaacaaattacttgaggtgggccccgggacccttcgccttatggagtcgttn

SEQ ID NO: 284185 - DNA, 1455 bp, Homo sapiens
ccattttatagataggcaggcagagaaagatgaattgcttgcttttcttttgggaacctggattcttttaatagttgttgaagcctccagggggccaggcggatcacttgaggcccagcctggccaacatagcgaaaccctgcctctactaaaaccacaaaaatcagccgggtatggtggcacacgcttataatcccagctatttgggacgctgaggtgggatatagcttgaacccgggaaggagactgcagtcagggaagcctagggaagcctcagaccaaggatgattgaataacaaagaaaaggtgtaagtaaagatctccaactcttagggagtactaattaggaaagttaagggtagaaaaagataaattaaggaaaataccgttgagatgctaatgggttaatttcagagaaaaaagactgagtagagggggtatggggaatgtgtgctggggagggagtgtgacgaaggtcgtaaagagacccttgctcaacgtcagttgacgttctgactgtggggaggtcgaaaactcggaagggcctgagggaaggaatgggcagtaccacgttctgacacctaggtcagtatggcgggggaagagtaaagaagacaaggaccgagaccctgccatgtcagtacctttctcttacggaggggcaccgccctgttggggtccacagccaaccccatctcggccaggttctgccgtaccgatttagcgtggtcccaggcatgtcggatgtgggagctaccggcaaagagagacatcgcggatccgtcatctcgcggaccgtcccggccgaggcccacggccacccggaaccccagccccctcaccattcgatccgcggcgctgccttccgtcgagcattccggttcagacgctttcggttgacactgtaaccaaacttctgcctccgggttttgcccttggccttgggcatcgcgctgaccaccgcaccagcagctcaaacacgctgcctctgtctctcagacctcgtgtaacaaactccttccggaaggcgtgcacaaggctttgcgggcatttggggaaatgtagtccttttgtagcactaccgtgctgagcactacgactcccaggatgcaacgagcatttgcgcctgcgtacaaggctcaatttattcgtttccccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccaagtcagaatcggtcgaacggaacgtgtcatagtgctgccggcgctcctagctatctcacagcaagcaggttcgtctgtggcacgacgcgcagttccggcgactctgtgtcgcgtatgtatattcactacc

SEQ ID NO: 284186 - DNA, 266 bp, Homo sapiens
cctagttttagaagtttcaatagcacctagttttagaagtttcaaaacccagggagcaaccactggccctaccgtgggacttactccctcctctcctttgagaggcccatgtgtcgctggggaggaagtgaccctttgtgtaactgtaaccgaaagttttttcaaaaatcctagatgctgttgtttgaatgttacatacttctatttgtgccacatctcccctccactcccctgcttaataaactctaaaaatccacttgtattta

SEQ ID NO: 284187 - DNA, 1145 bp, Homo sapiens
cctgacctgcctgtcgtcgtggtggccaacaagcaggttctgccgtaccgatttagcgtggtcccaggcatgtcggatgtgggagctaccggcaaagagagacatcgcggatccgtcatctcgcggaccgtcccggccgaggcccacggccacccggaaccccagccccctcaccattcgatccgcggcgctgccttccgtcgagcattccggttcagacgctttcggttgacactgtaaccaaacttctgcctccgggttttgcccttggccttgggcatcgcgctgaccaccgcaccagcagctcaaacacgctgcctctgtctctcagacctcgtgtaacaaactccttccggaaggcgtgcacaaggctttgcgggcatttggggaaatgtagtccttttgtagcactaccgtgctgagcactacgactcccaggatgcaacgagcatttgcgcctgcgtacaaggctcaatttattcgtttccccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagctccgcagaaatgattccaaaacccagggagcaaccactggccctaccgtgggacttactccctcctctcctttgagaggcccatgtgtcgctggggaggaagtgaccctttgtgtaactgtaaccgaaagttttttcaaaaatcctagatgctgttgtttgaatgttacatacttctatttgtgccacatctcccctccactcccctgcttaataaactctaaaaatccacttgtattta

SEQ ID NO: 284188 - DNA, 2170 bp, Homo sapiens
ccattttatagataggcaggcagagaaagatgaattgcttgcttttcttttgggaacctggattcttttaatagttgttgaagcctccagggggccaggcggatcacttgaggcccagcctggccaacatagcgaaaccctgcctctactaaaaccacaaaaatcagccgggtatggtggcacacgcttataatcccagctatttgggacgctgaggtgggatatagcttgaacccgggaaggagactgcagtcagggaagcctagggaagcctcagaccaaggatgattgaataacaaagaaaaggtgtaagtaaagatctccaactcttagggagtactaattaggaaagttaagggtagaaaaagataaattaaggaaaataccgttgagatgctaatgggttaatttcagagaaaaaagactgagtagagggggtatggggaatgtgtgctggggagggagtgtgacgaaggtcgtaaagagacccttgctcaacgtcagttgacgttctgactgtggggaggtcgaaaactcggaagggcctgagggaaggaatgggcagtaccacgttctgacacctaggtcagtatggcgggggaagagtaaagaagacaaggaccgagaccctgccatgtcagtacctttctcttacggaggggcaccgccctgttggggtccacagccaaccccatctcggccaggttctgccgtaccgatttagcgtggtcccaggcatgtcggatgtgggagctaccggcaaagagagacatcgcggatccgtcatctcgcggaccgtcccggccgaggcccacggccacccggaaccccagccccctcaccattcgatccgcggcgctgccttccgtcgagcattccggttcagacgctttcggttgacactgtaaccaaacttctgcctccgggttttgcccttggccttgggcatcgcgctgaccaccgcaccagcagctcaaacacgctgcctctgtctctcagacctcgtgtaacaaactccttccggaaggcgtgcacaaggctttgcgggcatttggggaaatgtagtccttttgtagcactaccgtgctgagcactacgactcccaggatgcaacgagcatttgcgcctgcgtacaaggctcaatttattcgtttccccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggtaagtgggtgcggtaggaactgcacaaggagaggacagtgatgtcggagggaaggaagtagagaaggaccagagcgctagcggggagcggaaggagagcggactagagaagagacgagggggcggggcggtgaggggcgaaactgattggagcgggagcagcgggtttagggggcgggatttggggcctaagattgggaggactctgtaactaggaagacctcgactcgacctaccctcgccgccctccctccgctgtgatccagagatcttggctttggggaagcgagacccaaagcggggaatgacctgcggggcccgacctgctgtttcccagttgctttgtcccctcctcaggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagctccgcagaaatgattccaaaacccagggagcaaccactggccctaccgtgggacttactccctcctctcctttgagaggcccatgtgtcgctggggaggaagtgaccctttgtgtaactgtaaccgaaagttttttcaaaaatcctagatgctgttgtttgaatgttacatacttctatttgtgccacatctcccctccactcccctgcttaataaactctaaaaatccacttgtattta

SEQ ID NO: 284189 - DNA, 1798 bp, Homo sapiens
ccattttatagataggcaggcagagaaagatgaattgcttgcttttcttttgggaacctggattcttttaatagttgttgaagcctccagggggccaggcggatcacttgaggcccagcctggccaacatagcgaaaccctgcctctactaaaaccacaaaaatcagccgggtatggtggcacacgcttataatcccagctatttgggacgctgaggtgggatatagcttgaacccgggaaggagactgcagtcagggaagcctagggaagcctcagaccaaggatgattgaataacaaagaaaaggtgtaagtaaagatctccaactcttagggagtactaattaggaaagttaagggtagaaaaagataaattaaggaaaataccgttgagatgctaatgggttaatttcagagaaaaaagactgagtagagggggtatggggaatgtgtgctggggagggagtgtgacgaaggtcgtaaagagacccttgctcaacgtcagttgacgttctgactgtggggaggtcgaaaactcggaagggcctgagggaaggaatgggcagtaccacgttctgacacctaggtcagtatggcgggggaagagtaaagaagacaaggaccgagaccctgccatgtcagtacctttctcttacggaggggcaccgccctgttggggtccacagccaaccccatctcggccaggttctgccgtaccgatttagcgtggtcccaggcatgtcggatgtgggagctaccggcaaagagagacatcgcggatccgtcatctcgcggaccgtcccggccgaggcccacggccacccggaaccccagccccctcaccattcgatccgcggcgctgccttccgtcgagcattccggttcagacgctttcggttgacactgtaaccaaacttctgcctccgggttttgcccttggccttgggcatcgcgctgaccaccgcaccagcagctcaaacacgctgcctctgtctctcagacctcgtgtaacaaactccttccggaaggcgtgcacaaggctttgcgggcatttggggaaatgtagtccttttgtagcactaccgtgctgagcactacgactcccaggatgcaacgagcatttgcgcctgcgtacaaggctcaatttattcgtttccccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagctccgcagaaatgattccaaaacccagggagcaaccactggccctaccgtgggacttactccctcctctcctttgagaggcccatgtgtcgctggggaggaagtgaccctttgtgtaactgtaaccgaaagttttttctgttgtttgaatgttacatacttctatttgtgccacatctcccctccactcccctgcttaataaactctaaaaatccacttgtattta

SEQ ID NO: 284190 - DNA, 2804 bp, Homo sapiens
acttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattggggtatcaacattaccgcccctgtctctcttcattcccctatcaacattaccgcccctgtctcttctgtaactacttcagactcagccctcctggaggctgtcatgtaggggactctcgaggttcctttgttctaccccatctctcccccccgaattc

SEQ ID NO: 284191 - DNA, 488 bp, Homo sapiens
gcgccccctactactactacatttgcggccggtcgacgaaaaaggcaagaagcaggactgttgccaaaaaactggtggtattcagacctaggctatttttattgtgctttgggataattttcttaattggttaaaacacaaaatcatgggcttagtagagtaaaaccagtaaaaccagatagtagtcactaatcccagtcagccattcaggtctttaggagttccagatgatggatcagcacaagtctgtcgtcaccgaaaattagtcctcttgttcttccaggggagtattagtttaataatcggttttttaaaaaatatttatattataaatatgttgaagatgttaaaaggtgataaattactcagattttgttggataacatatttgttgccaaattccactcttttctgagctgatcagacttctcagctacactgtttttttgaatcagcaagtcaataaacatttatcaaatttccactct

SEQ ID NO: 284192 - DNA, 2807 bp, Homo sapiens
acttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctcttctgtaactacttcagactcagccctcctggaggctgtcatgtaggggactctcgaggttcctttgttctaccccatctctcccccccgaattc

SEQ ID NO: 284193 - DNA, 721 bp, Homo sapiens
ggtcgatctcatagacggatcccccacatttgcaggatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctcttctgtaactacttcagactcagccctcctggaggctgtcatgtaggggactctcgaggttcctttgttctaccccatctctcccccccgaattc

SEQ ID NO: 284194 - DNA, 719 bp, Homo sapiens
gcgccccctactactactacatttgcggccggtcgacgaaaaaggcaagaagcaggactgttgccaaaaaactggtggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtaagtacagagagcagggagaagtagtgaaggctgcatttctttccattacatgaaactatttgataaaactgggactgttttccaatacccaaggaaaataagtcactgagattatctctcaaaataaatttttcccccataaacagaatcttctttacctttttaatagacaagcaaatatttatttggaggtaatactttttgttttttttgggtttttttgagatagaggctcactccagcctgggtgatagagcaagactctgtctaaaaaaataccaaaaaaacaaatcctgttgatgggctaaagaggataaggactgtttatcagtatataatctat

SEQ ID NO: 284195 - DNA, 364 bp, Homo sapiens
aaatatgggagacgacagaccgtttgtgtgcaatgccccgggctgtggacaggtacgtttacaatatactttattgtgaatgtctcgttgtgaatcaaagtggctgttttatcactaaggcaaagagtttaaagccagtattttacgtgatcactggaggtaatcagatcagaggatttgcagtgtgtaaatccaagttatgaggaagtgtaggcactctaccgtaatgaaatctgccttgctgtcttccatattgttattctactggtgtttgtttcccaccacacagtatggaaaaatacatgttgctgtctcctcctttctaaagctgtccatctaaatacaaagcaagtttagaaatgtt

SEQ ID NO: 284196 - DNA, 863 bp, Homo sapiens
acttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggtattcagacctaggctatttttattgtgctttgggataattttcttaattggttaaaacacaaaatcatgggcttagtagagtaaaaccagtaaaaccagatagtagtcactaatcccagtcagccattcaggtctttaggagttccagatgatggatcagcacaagtctgtcgtcaccgaaaattagtcctcttgttcttccaggggagtattagtttaataatcggttttttaaaaaatatttatattataaatatgttgaagatgttaaaaggtgataaattactcagattttgttggataacatatttgttgccaaattccactcttttctgagctgatcagacttctcagctacactgtttttttgaatcagcaagtcaataaacatttatcaaatttccactct

SEQ ID NO: 284197 - DNA, 781 bp, Homo sapiens
tcctttggggggaaggcggggccagaggcttgaagtgtggggagaacttggtctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggtattcagacctaggctatttttattgtgctttgggataattttcttaattggttaaaacacaaaatcatgggcttagtagagtaaaaccagtaaaaccagatagtagtcactaatcccagtcagccattcaggtctttaggagttccagatgatggatcagcacaagtctgtcgtcaccgaaaattagtcctcttgttcttccaggggagtattagtttaataatcggttttttaaaaaatatttatattataaatatgttgaagatgttaaaaggtgataaattactcagattttgttggataacatatttgttgccaaattccactcttttctgagctgatcagacttctcagctacactgtttttttgaatcagcaagtcaataaacatttatcaaatttccactct

SEQ ID NO: 284198 - DNA, 2028 bp, Homo sapiens
acttctcgcgagagttgagcgcgcctggccggacgggaggaaagtatccgttccgccaaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggcaagaagcaggactgttgccaaaaaactggtggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaatttttggctctagaagaatggattttcatagttacctctttccctgccgtagttttaccctcaa

SEQ ID NO: 284199 - DNA, 1729 bp, Homo sapiens
gcgtacaacccggaagttggcgcagcgcggttgccaatggtcgctccctgagaggatgccgctcgtggtgttttgcgggctgccgtacagcggcaagagccggcgtgctgaagagttgcgcgtggcgctggctgccgagggccgcgcggtgtacgtggtggacgacgcagctgtcctgggcgcagaggacccagcggtgtacggcgattctgcccgtgagaaggcattgcgtggagctctgcgagcctccgtggaacggcgcctgagtcgccacgacgtggtcatcctggactcgcttaactacatcaaaggtttccgttacgagctctactgcctggcacgggcggcgcgcaccccgctctgcctggtctactgcgtacggcccggcggcccgatcgcgggacctcaggtggcgggcgcgaacgagaaccctggccggaacgtcagtgtgagttggcggccacgcgctgaggaggacgggagagcccaggcggcgggcagcagcgtcctcagggaactgcatactgcggactctgtagtaaatggaagtgcccaggccgacgtacccaaggaactggagcgagaagaatccggggctgcggagtctccagctcttgtgactccggattcagagaaatctgcaaagcatgggtccggtgccttttactctcccgaactcctggaggccctaacgctgcgctttgaggctcccgattctcggaatcgctgggaccggcctttattcactttggtgggcctagaggagccgttgcccctggcggggatccgctctgccctgtttgagaaccgggccccaccaccccatcagtctacgcagtcccagcccctcgcctccggcagctttctgcaccagttggaccaggtcacgagtcaagtactggccggattgatggaagcgcagaagagcgctgtccccggggacttgctcacgcttcctggtaccacagagcacttgcggtttacccggcccttgaccatggcagaactgagtcgccttcgtcgccagtttatttcgtacactaaaatgcatcccaacaatgagaacttgccgcaactggccaacatgtttcttcagtatttgagccagagcctgcactgaccagaggaggtaggggggaagccatggcttctgatctccactccactttatttctctgggaaaaataggctgcaggtctccagagcatatcgatgcagtactgtactagagctgttgtgactgattcactcaaactttcctgcatacccctgtgccaggccttgggtttacagcataagttcagactaaagagaatggagaactattgtggtgcaacctggcaaatccctcagaggacagagctaaggtggacagggattacctagattggatcctacttgggctatcacagagcattgaccattggcttccctcatctgaggcgtgggagagcagactggatagatgagaattgttttaaaacaattgtgaacagaaactgaagatggtacagttctacatctgcacctgcccttttttcataccacaaaagtattttttgagtactgtactgactttttgctagtttctattctgggaccgagttcacagataaatccattggtttgtatccttgagaaactttgtttttgtggaagtaagaaagttatctactagattatttcctctaataaaatcttttaaaatagtctactggaatctctttca

SEQ ID NO: 284200 - DNA, 779 bp, Homo sapiens
ctgatctagaggatacctcgaatcgacggtttctccggcccttgaccatggcagaactgagtcgccttcgtcgccagtttatttcgtacactaaaatgcatcccaacaatgagaacttgccgcaactggccaacatgtttcttcagtatttgagccagagcctgcactgaccagaggaggtaggggggaagccatggcttctgatctccactccactttatttctctgggaaaaataggctgcaggtctccagagcatatcgatgcagtactgtactagagctgttgtgactgattcactcaaactttcctgcatacccctgtgccaggccttgggtttacagcataagttcagactaaagagaatggagaactattgtggtgcaacctggcaaatccctcagaggacagagctaaggtggacagggattacctagattggatcctacttgggctatcacagagcattgaccattggcttccctcatctgaggcgtgggagagcagactggatagatgagaattgttttaaaacaattgtgaacagaaactgaagatggtacagttctacatctgcacctgcccttttttcataccacaaaagtattttttgagtactgtactgactttttgctagtttctattctgggaccgagttcacagataaatccattggtttgtatccttgagaaactttgtttttgtggaagtaagaaagttatctactagattatttcctctaataaaatcttttaaaatagtctactggaatctctttca

SEQ ID NO: 284201 - DNA, 1702 bp, Homo sapiens
gcgtacaacccggaagttggcgcagcgcggttgccaatggtcgctccctgagaggatgccgctcgtggtgttttgcgggctgccgtacagcggcaagagccggcgtgctgaagagttgcgcgtggcgctggctgccgagggccgcgcggtgtacgtggtggacgacgcagctgtcctgggcgcagaggacccagcggtgtacggcgattctgcccgtgagaaggcattgcgtggagctctgcgagcctccgtggaacggcgcctgagtcgccacgacgtggtcatcctggactcgcttaactacatcaaaggtttccgttacgagctctactgcctggcacgggcggcgcgcaccccgctctgcctggtctactgcgtacggcccggcggcgcgaacgagaaccctggccggaacgtcagtgtgagttggcggccacgcgctgaggaggacgggagagcccaggcggcgggcagcagcgtcctcagggaactgcatactgcggactctgtagtaaatggaagtgcccaggccgacgtacccaaggaactggagcgagaagaatccggggctgcggagtctccagctcttgtgactccggattcagagaaatctgcaaagcatgggtccggtgccttttactctcccgaactcctggaggccctaacgctgcgctttgaggctcccgattctcggaatcgctgggaccggcctttattcactttggtgggcctagaggagccgttgcccctggcggggatccgctctgccctgtttgagaaccgggccccaccaccccatcagtctacgcagtcccagcccctcgcctccggcagctttctgcaccagttggaccaggtcacgagtcaagtactggccggattgatggaagcgcagaagagcgctgtccccggggacttgctcacgcttcctggtaccacagagcacttgcggtttacccggcccttgaccatggcagaactgagtcgccttcgtcgccagtttatttcgtacactaaaatgcatcccaacaatgagaacttgccgcaactggccaacatgtttcttcagtatttgagccagagcctgcactgaccagaggaggtaggggggaagccatggcttctgatctccactccactttatttctctgggaaaaataggctgcaggtctccagagcatatcgatgcagtactgtactagagctgttgtgactgattcactcaaactttcctgcatacccctgtgccaggccttgggtttacagcataagttcagactaaagagaatggagaactattgtggtgcaacctggcaaatccctcagaggacagagctaaggtggacagggattacctagattggatcctacttgggctatcacagagcattgaccattggcttccctcatctgaggcgtgggagagcagactggatagatgagaattgttttaaaacaattgtgaacagaaactgaagatggtacagttctacatctgcacctgcccttttttcataccacaaaagtattttttgagtactgtactgactttttgctagtttctattctgggaccgagttcacagataaatccattggtttgtatccttgagaaactttgtttttgtggaagtaagaaagttatctactagattatttcctctaataaaatcttttaaaatagtctactggaatctctttca

SEQ ID NO: 284202 - DNA, 1115 bp, Homo sapiens
ggctggtactggctcgggattatgggcatgtggaagggaggtcacgctatcgtccgcggccccagcagccctgtgccctcgttggatcccgcgacgcggctcctttaagagcctcgcgggtcgcccgccgctaggtcgctccccggccatgcgggcgctgcgggccggcctgaccctggcgttgggcgcggggctgggtgcggtcgtcgagggctggcggcggcggcgggaggacgcgcgggcggcgccgggactgctgggccggctgcccgtgctgcccgtggcggcggcagccgagttgccccctgtgcccgggggaccccgcggcccgggcgagctggccaagtacgggctgccggggctggcgcagtcaagagccgcgagtcgtacgtgctgtgctacgacccgcgcacccgcggcgcgctctgggtggtggagcagctgcgacccgagcgtctccgcggcgaacggcgaccggcgcgagtgcgacttccgcgaggacgactcggtgcacgcgtaccaccgtgccaccaacgccgactaccgcggcagtggcttcgaccgcggtcacttggccgccgccgccaaccaccgctggagccagaaggccatggacgacacgttctacctgagcaacgtcgcgccccaggtgccccacctcaaccagaatgcctggaacaacctggagaaatatagccgcagcttgacccgcagctaccaaaacgtctatgtctgcacagggccactcttcctgcccaggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggagacaagt

SEQ ID NO: 284203 - DNA, 475 bp, Homo sapiens
tcccagagaccctgggtggggctggggacaggcctcattcctctctgaaaggtggagacaggctcttccttcattcgactcttgggagctgagaaaagactttgactcctgggctgtgggagggacagatggtggtggctaccactctatcagccctgggtttcagggagtgactttcattccttgagcctcagtttccccccgcttgtctcactggatatctctgagcctgtccatcccctcaggacctggggcggccctctgatagaggaggaagggtcccagccacagtcctgctaagccctatctctcctaccaggtgccccacctcaaccagaatgcctggaacaacctggagaaatatagccgcagcttgacccgcagctaccaaaacgtctatgtctgcacagggccactcttcctgcccaggtaaggtggaaaccaggggggcggcagaacctcccactcacccgag

SEQ ID NO: 284204 - DNA, 1151 bp, Homo sapiens
cacccggttgggctctgctgctcccttctgggttccgaggcccaagcccttggcagtgtttgtgagtggaagggaggtcacgctatcgtccgcggccccagcagccctgtgccctcgttggatcccgcgacgcggctcctttaagagcctcgcgggtcgcccgccgctaggtcgctccccggccatgcgggcgctgcgggccggcctgaccctggcgttgggcgcggggctgggtgcggtcgtcgagggctggcggcggcggcgggaggacgcgcgggcggcgccgggactgctgggccggctgcccgtgctgcccgtggcggcggcagccgagttgccccctgtgcccgggggaccccgcggcccgggcgagctggccaagtacgggctgccggggctggcgcagtcaagagccgcgagtcgtacgtgctgtgctacgacccgcgcacccgcggcgcgctctgggtggtggagcagctgcgacccgagcgtctccgcggcgaacggcgaccggcgcgagtgcgacttccgcgaggacgactcggtgcacgcgtaccaccgtgccaccaacgccgactaccgcggcagtggcttcgaccgcggtcacttggccgccgccgccaaccaccgctggagccagaaggccatggacgacacgttctacctgagcaacgtcgcgccccaggtgccccacctcaaccagaatgcctggaacaacctggagaaatatagccgcagcttgacccgcagctaccaaaacgtctatgtctgcacagggccactcttcctgcccaggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggagacaagt

SEQ ID NO: 284205 - DNA, 576 bp, Homo sapiens
tatcagccctgggtttcagggagtgactttcattccttgagcctcagtttccccccgcttgtctcactggatatctctgagcctgtccatcccctcaggacctggggcggccctctgatagaggaggaagggtcccagccacagtcctgctaagccctatctctcctaccaggtgccccacctcaaccagaatgcctggaacaacctggagaaatatagccgcagcttgacccgcagctaccaaaacgtctatgtctgcacagggccactcttcctgcccaggtaaggtggaaaccaggggggcggcagaacctcccactcacccgaggcccctactgccactcacagggccaggcttgccccaggctctgggtcaataccagttccctactcatctggtttcttggcaagcctgtcagcttccctgcctcgagtcccctcattccacctccacagccaaagacctgtcgggtacccctgaccatctctcctctgcccatgggcagcagcaggccctgaatctgcccccgcttctccctgctgtcacctcttggcatgcccacccaatcttgttct

SEQ ID NO: 284206 - DNA, 504 bp, Homo sapiens
tggtggtgagtatctttcttgttgaaactttgacatacagttttaacaatagctctatataaaaggcggcagtagtatttctagcttgaagaagttactgttcagttatgtcattaaaatattttaatcctatcattttttttttactctgaacaagttactgtagaaacaagatgctgatgtgagcatctaaaaagtggactcttaaggccaggcgcggtggctcacgcctgtaatctcagcacttgggaggccgaggcgggcagatcacctgaggtcaggagttcaagaccagcctggccagcaggtgaaaacccatctctactaaaaatagaaaagttagttgggcatggtggtggtggcaggcgcctgtagtgccagctcttcaggaagctaaggtaggagaatcacttgaacctggttggtggaggttgcagtcagcctgagatggtgccactgcactccagcctgggtgctagagtgagactccattaaaaaaaaaaa

SEQ ID NO: 284207 - DNA, 807 bp, Homo sapiens
cccgagccgggagggaagcctggggaggacacctggggggcacggccctgaccacgctcagacccaagagggcggggaggggcgcagggcgcgtggggggcgcgggcgcacttactcgagctccttgaagcgctcgcggcccgccgccacgtacttgccgcccgcctgcagcgcgtccagccccagcacccggtgcccacgcgtgggcgtgaagaggcggcgcacgccgaacgggacgtccacctgctccgtgagctgctccagcagcgcctcgaaggttgaatttgaccggttcagccccagtgtcttccaggactcctggcccagagtggggaatttgagcttttccaccagaggaggaggtgtgcagagccactgggaggccgtgaggaaccgcgctatagccgctggtgtgcggtgtcaggcgcgtgccattcagaacgcatcctcattggggaatgattcaaagggagagggggtctttggaagaatcgttcctactctgggtaaagataggccagtccccttgagtgattctagacagtcagtaggctacatgttacggctggaagtccacaccgaaggtacagatattgatattatgagtattaatatcttataatgttcaaaaaaagtagttccgtagagaccaccagtcacagccatagccagtatgtaagctactaaatgcctcatagcaacattaaatacagagatcaatttgtgagacgaccactttattaaatcaccaggtgttcaaaacatttgaaaagaagactatgactgggaaattactgctgtgtgtcc

SEQ ID NO: 284208 - DNA, 558 bp, Homo sapiens
cccgagccgggagggaagcctggggaggacacctggggggcacggccctgaccacgctcagacccaagagggcggggaggggcgcagggcgcgtggggggcgcgggcgcacttactcgagctccttgaagcgctcgcggcccgccgccacgtacttgccgcccgcctgcagcgcgtccagccccagcacccggtgcccacgcgtgggcgtgaagaggcggcgcacgccgaacgggacgtccacctgctccgtgagctgctccagcagcgcctcgaaggtggccgcgcggcgccgcgacagcacgaacttcttgcccacgtagaacgggtccccgttgcggtacaccacgatggtcttggcgggcgtggtgtccaccggcgcggagggcccgcgggttcccatagccgcgccccgctcctcgctcgccggggccgagaggctgcggcagcgcgggcagcgacgcctgcagagccgcgcccaggcccgggcaccgccgacgggaggtccgctccagccgctggcgcaggacggggacgggacggggacgggacgggggct

SEQ ID NO: 284209 - DNA, 2060 bp, Homo sapiens
ggcccgcgggctagaggcactttaccgcccggcgggagcgcctctcctccgcgtccctcgccccagccccctgcccgccccactttgggaccctccagccgctttccccacgaatgagatctttgcaatgagcaaacgaaagtggcgcggatttcggggcgcccagcaggagcgagcgcagccgccagccgcaagtccgcagccgtgtcccgcgccccacgccggcctccccggcggcagccggagacgagcgccagcaccggcgggacagcagcagatgcgggccgagagccggtcaggggcgcagaggcggaggggatcggcgcggcggggagctcaccgcgaagctggaggctgcgtccgcgggcgcaccaggagctcaggcagcgagcgatcgaacgctctgtggcaggcggtggacgctgctgaagctctggctctgagctcaccgctccgccgtccgtgggaccaagcccagcattttacaaacccagctcctgtctccaagggtcctcagagcgcccctccgtcaccccctgcagggcgccgcagacgaggcgctgaccttgcgctcgctcccctcgctggggaaggacacactcgctggcgtcagccggccggcctgggaagtaggactaaggacccgaactgcaaccctccacaccagacagcacagaccaccccaaggctgctcaatctgcccaaagccaaaagagctcccctgccaggacctcggtgccgtggagactgcggggaacctgctctgcccacacctgctctggcccctagacggaagcacctggagccaaccacggaactccagatcccagctgtgtgactgaatccacgccagcctctctgagccaaagctgcttgcagaagggggagatcccagttcgaagactcccgcgcagagcctgtggccctctctgccaggcctcagggtgcctgagacactcacctctctgcctcgcagttggggctgaggctggggctggctgccagcctcagttctgggagcgctggggtcgcctgggccacaggccacagcagctcacctcaggactgggctctctggcctgctggggctcaggctgtggggcaggctgggcagggggctgagctggcagcgattcagagccctggggctgggggctggaatccacctcctcccacacaagctcggtggtgactcttcggcccctggggaaaaacaaaaagatattgctgagatgacctcttttaaaagcaaagcccccctccccatacaccccaggcctgagccctgtcccatccccctccccgggttccttcaggtcaccttgtcaggatctgggcagcggcttccccctctagcccctcccctgcctagagctccctctttcaaagtataagggagggaagaagtggtgagaagtttgcctagaaagggcttcccggtgctgatggagaggccgagacccttctgttggacaggctgccctgttcctgggtgaggatgggcttctgcctggcactgggggtggagggtgcacacgaatggcccgccttgaggggtcatggcacggaatatgaaagcctcctccacctccaaacacccccaccttggaaggagataaggagggggccccagcaaaagccactggacacacagctctgcttgacgaggccagtgagggacggcgtggctgtgcttcctggggaaatgaaccccctccccacagacaccaccctgggtggattgaggagtctgggtccagggtgcaacagagaaaaacttcatgcatgaatgagcattcccagggaaactgccttggccccagggcgcctctctgtgccagggaggctgggagagcagcaagggggaccaggtgcgccatcaggaggagagaagctaaacctaggggggacatggagggccgttgttgcctctcccggcgtttctcctcagtctcctgtccaatttcttgctggtggtcagcaggcatagggaggcaggagggaaggaagctttacctgtaaaatggtgtatatatgtataaataaaatatctgcgccag

SEQ ID NO: 284210 - DNA, 1949 bp, Homo sapiens
ggcccgcgggctagaggcactttaccgcccggcgggagcgcctctcctccgcgtccctcgccccagccccctgcccgccccactttgggaccctccagccgctttccccacgaatgagatctttgcaatgagcaaacgaaagtggcgcggatttcggggcgcccagcaggagcgagcgcagccgccagccgcaagtccgcagccgtgtcccgcgccccacgccggcctccccggcggcagccggagacgagcgccagcaccggcgggacagcagcagatgcgggccgagagccggtcaggggcgcagaggcggaggggatcggcgcggcggggagctcaccgcgaagctggaggctgcgtccgcgggcgcaccaggagctcaggcagcgagcgatcgaacgctctgtggcaggcggtggacgctgctgaagggcgccgcagacgaggcgctgaccttgcgctcgctcccctcgctggggaaggacacactcgctggcgtcagccggccggcctgggaagtaggactaaggacccgaactgcaaccctccacaccagacagcacagaccaccccaaggctgctcaatctgcccaaagccaaaagagctcccctgccaggacctcggtgccgtggagactgcggggaacctgctctgcccacacctgctctggcccctagacggaagcacctggagccaaccacggaactccagatcccagctgtgtgactgaatccacgccagcctctctgagccaaagctgcttgcagaagggggagatcccagttcgaagactcccgcgcagagcctgtggccctctctgccaggcctcagggtgcctgagacactcacctctctgcctcgcagttggggctgaggctggggctggctgccagcctcagttctgggagcgctggggtcgcctgggccacaggccacagcagctcacctcaggactgggctctctggcctgctggggctcaggctgtggggcaggctgggcagggggctgagctggcagcgattcagagccctggggctgggggctggaatccacctcctcccacacaagctcggtggtgactcttcggcccctggggaaaaacaaaaagatattgctgagatgacctcttttaaaagcaaagcccccctccccatacaccccaggcctgagccctgtcccatccccctccccgggttccttcaggtcaccttgtcaggatctgggcagcggcttccccctctagcccctcccctgcctagagctccctctttcaaagtataagggagggaagaagtggtgagaagtttgcctagaaagggcttcccggtgctgatggagaggccgagacccttctgttggacaggctgccctgttcctgggtgaggatgggcttctgcctggcactgggggtggagggtgcacacgaatggcccgccttgaggggtcatggcacggaatatgaaagcctcctccacctccaaacacccccaccttggaaggagataaggagggggccccagcaaaagccactggacacacagctctgcttgacgaggccagtgagggacggcgtggctgtgcttcctggggaaatgaaccccctccccacagacaccaccctgggtggattgaggagtctgggtccagggtgcaacagagaaaaacttcatgcatgaatgagcattcccagggaaactgccttggccccagggcgcctctctgtgccagggaggctgggagagcagcaagggggaccaggtgcgccatcaggaggagagaagctaaacctaggggggacatggagggccgttgttgcctctcccggcgtttctcctcagtctcctgtccaatttcttgctggtggtcagcaggcatagggaggcaggagggaaggaagctttacctgtaaaatggtgtatatatgtataaataaaatatctgcgccag

SEQ ID NO: 284211 - DNA, 289 bp, Homo sapiens
acatgcaggctgcgctgggggccgtgacctggagccgtggccagggggacagcatcctggagccagaaatgtctgacagctcatcctcatctcattctatggatgagaaaaaagagaccgctggggtcgtggggacaggggtacgttgcgtgcctctgacgccttatctgaagaccagaatggcctcctgtgacctgatggtgtctgatgcctaggacatccaactacccccaagaagtcttttcacccagaacatataatcccccagccttggcaccataacttatat

SEQ ID NO: 284212 - DNA, 901 bp, Homo sapiens
tgcctcctgtttgtcaaatagaatgaatggtgatggtgatgggagggatagttaaacgttttctctgctaggttaacttcttacaggtataattacaatgcctgaaattctgtagtttcatttctttggattagtcgttgtcttttccagattgtacacaatctgatcaacacaaaggtagttagtagatcattaacctcaattgcaaggttataatttctcaaacattaagcatattatcagagtcctactagaaacaaacattccaaatgaactctgaatgcctgactcaggcgttttggaggtttgggttatccccttgtcattaggcacacaagggttttttgttgtttttgttttttgggtttttgttttgttttgaggcagtctcgctctgttgtacaagctggagtgctgtattgtgatcttgactcactgcaacctctgcctcctggttcaagcgattctcccagctaacttagccaggctgaggcaggaagtataggtcggaacccaggaggcagcagtagcgagtgagccaagatcgtgccagtaatccagcctggggcaaaatagcaagaaccgacccacatctctactaaacacacgaacctttaacacacgttgacactacgcagtcctagaagaatttacgaaacaagcagcaataagttacttgttggcccttgagacaacccggtgcgggcctgctcttaacggcactctaatataggtactcgtaaagggacacagcaggaagccactggcaaaagcacgcacgtcctacagactataaccaaaggatcaacctagagaaacgggagtcaccaattcaaccgggccgacacagcgcggaagcaacagcctgaccagggccctaggacagcagcaaagccctgaa

SEQ ID NO: 284213 - DNA, 527 bp, Homo sapiens
gaacatctctgcttccacccaaaaccacagcctttgaatattatataaggaacttaatggatagatatgtttattatttttgatagcacaactgctttctctgctattataaggaaaactgagaatagcaggtgggtagggtaggatgaggaaacaagatgcccaaagcctagatgccacagaattcatggtgataatcagggcatattttgagtcctactagaaacaaacattccaaatgaactctgaatgcctgactcaggcgttttggaggtttgggttatccccttgtcattaggcacacaagggttttttgttgtttttgttttttgggtttttgttttgttttgaggcagtctcgctctgttgtacaagctggagtgctgtattgtgatcttgactcactgcaacctctgcctcctggttcaagcgattctcctgccttggcctcctgagtagctgggattataagtgcctgccactatgcccggctaatttttgtatttttagtggagatggagttttgc

SEQ ID NO: 284214 - DNA, 1788 bp, Homo sapiens
attgtccactcttacttataaaacacttttttgttcattgtttaatcttgatagcagtattgaggctggtatttatatgataggttatgaaacaggttcaaagaagttgtgtcttggaaaaaaagtgacaatgcttttgaaaatgatgacgaaaaaggcatcttgtctgttaaccacagcttgctttaatagaatcctgggagggtgattgggactttttagtattacaaccttagtgtcattgaggaggattttggtctagttagtgggctgagtttcatatacctctccctccatgtgcaggtttgttaagataattggtagtttttaataatataaaatacttaagttgaaatacaaaagtgtggcaacaattattaaatattggctagaattctaggagagttacacaactagtggaagtccatgtttagaaaataaatggcttgtttaaggaaaagtttttgtgtccaaagctccttaaagtcagagagatttctacctggtacttaacatcatatggaaattgatgctttagtgagggtgttggctatcctattgtcaatttcctgcatccttttttcttctttatttttgtatagagacaaggtctcgctatgttgcccaggctggtcttgttcctgggctcaagcagtcctcccgcctcggtctcccaaagtgccgggattacaggtgtgagccactgtgcccagcttatccttttttcattacacaaaaagactgaatttggttagttctaagttggaagataaagatggtatgcacaggaggcccttgggagccctcagataactttctcattcttccaaaatcaggctgggatgcattctgtaaattttccctgcctaggatgtatacctgaggaataaggtaaggaagatgtcagcaagtcagcctctggtttacctgctagctggcatggatccttaaggaagcaggagggagttgggaagagaggaaggggtgaagttggtatcttttaaagcgagagtgattttacctcagattttgaagaatactaaggaatccagttgttggggtacatgctattattagaaggatctagataatttgtcctctgagtcatacttgacattgtacctgtggcacatcaatccgcactgtttgatactctggctgaatctcagctttcaccaacattgtcaaaggaccttttttagtgcccagccatgcctaagagtgtgtcatctgaagagggaagcatctgcatactgctgtcctgattgctcagtcctcactacctaccagacccgttggtaaggtacaaaagtacatgcttggaaaagcagtctgcaccaccagtgataagctgtgacagagtggaacagcctcaatgaaatgaaggaaggattgctacagtggcattaaggatggtctcttaatcctgtgttaaccactagattaactttacaatcaactcaaaatccttcaaaggctttccactttctttagtggcattcagaccccctctagtttgacccctacctccaacttgaacctctgttactcttccgtatgaacattttcctctagccctggactactagtaccgaagtcactagtcacataggactcatttgaaatatgactagtctcaattgagatgtaatgtaagtgtaaaatacacagcagatttctaagacagcacacaaaatgtaaaatatgtcaaaaatatttgatactgattacatgttgaaatatatgtgttgggttaaataaaatgcattaaagttaaaaaaaaaaaat

SEQ ID NO: 284215 - DNA, 1592 bp, Homo sapiens
tgcctcctgtttgtcaaatagaatgaatggtgatggtgatgggagggatagttaaacgttttctctgctaggttaacttcttacaggtataattacaatgcctgaaattctgtagtttcatttctttggattagtcgttgtcttttccagattgtacacaatctgatcaacacaaaggtagttagtagatcattaacctcaattgcaaggttataatttctcaaacattaagcatattatcagtcatgtggattcaaacacagtataagaaaatcctcaaggctgggtgtgatggcttatgcctgtaatcccagctacttagcaggctgaggcaggagtattgtttgaacccaggaggcagagttgcagtgagccaagatcgtgccactactccagcctgggcaaaatagcaagacccgaccccccatctctactaaaaagaaatttaaaaaaatgaaataaaatcctagaaaattagaaaaagcaacaatagttacttgtgagccactgtgcccagcttatccttttttcattacacaaaaagactgaatttggttagttctaagttggaagataaagatggtatgcacaggaggcccttgggagccctcagataactttctcattcttccaaaatcaggctgggatgcattctgtaaattttccctgcctaggatgtatacctgaggaataaggtaaggaagatgtcagcaagtcagcctctggtttacctgctagctggcatggatccttaaggaagcaggagggagttgggaagagaggaaggggtgaagttggtatcttttaaagcgagagtgattttacctcagattttgaagaatactaaggaatccagttgttggggtacatgctattattagaaggatctagataatttgtcctctgagtcatacttgacattgtacctgtggcacatcaatccgcactgtttgatactctggctgaatctcagctttcaccaacattgtcaaaggaccttttttagtgcccagccatgcctaagagtgtgtcatctgaagagggaagcatctgcatactgctgtcctgattgctcagtcctcactacctaccagacccgttggtaaggtacaaaagtacatgcttggaaaagcagtctgcaccaccagtgataagctgtgacagagtggaacagcctcaatgaaatgaaggaaggattgctacagtggcattaaggatggtctcttaatcctgtgttaaccactagattaactttacaatcaactcaaaatccttcaaaggctttccactttctttagtggcattcagaccccctctagtttgacccctacctccaacttgaacctctgttactcttccgtatgaacattttcctctagccctggactactagtaccgaagtcactagtcacataggactcatttgaaatatgactagtctcaattgagatgtaatgtaagtgtaaaatacacagcagatttctaagacagcacacaaaatgtaaaatatgtcaaaaatatttgatactgattacatgttgaaatatatgtgttgggttaaataaaatgcattaaagttaaaaaaaaaaaat

SEQ ID NO: 284216 - DNA, 1734 bp, Homo sapiens
attgtccactcttacttataaaacacttttttgttcattgtttaatcttgatagcagtattgaggctggtatttatatgataggttatgaaacaggttcaaagaagttgtgtcttggaaaaaaagtgacaatgcttttgaaaatgatgacgaaaaaggcatcttgtctgttaaccacagcttgctttaatagaatcctgggagggtgattgggactttttagtattacaaccttagtgtcattgaggaggattttggtctagttagtgggctgagtttcatatacctctccctccatgtgcaggtttgttaagataattggtagtttttaataatataaaatacttaagttgaaatacaaaagtgtggcaacaattattaaatattggctagaattctaggagagttacacaactagtggaagtccatgtttagaaaataaatggcttgtttaaggaaaagtttttgtgtccaaagctccttaaagtcagagagatttctacctggtacttaacatcatatggaaattgatgctttagtgagggtgttggctatcctattgtcaatttcctgcatccttttttcttctttatttttgtatagagacaaggtctcgctatgttgcccaggctggtcttgttcctgggctcaagcagtcctcccgcctcggtctcccaaagtgccgggattacaggtgtgagccactgtgcccagcttatccttttttcattacacaaaaagactgaatttggttagttctaagttggaagataaagatggtatgcacaggaggcccttgggagccctcagataactttctcattcttccaagaataaggtaaggaagatgtcagcaagtcagcctctggtttacctgctagctggcatggatccttaaggaagcaggagggagttgggaagagaggaaggggtgaagttggtatcttttaaagcgagagtgattttacctcagattttgaagaatactaaggaatccagttgttggggtacatgctattattagaaggatctagataatttgtcctctgagtcatacttgacattgtacctgtggcacatcaatccgcactgtttgatactctggctgaatctcagctttcaccaacattgtcaaaggaccttttttagtgcccagccatgcctaagagtgtgtcatctgaagagggaagcatctgcatactgctgtcctgattgctcagtcctcactacctaccagacccgttggtaaggtacaaaagtacatgcttggaaaagcagtctgcaccaccagtgataagctgtgacagagtggaacagcctcaatgaaatgaaggaaggattgctacagtggcattaaggatggtctcttaatcctgtgttaaccactagattaactttacaatcaactcaaaatccttcaaaggctttccactttctttagtggcattcagaccccctctagtttgacccctacctccaacttgaacctctgttactcttccgtatgaacattttcctctagccctggactactagtaccgaagtcactagtcacataggactcatttgaaatatgactagtctcaattgagatgtaatgtaagtgtaaaatacacagcagatttctaagacagcacacaaaatgtaaaatatgtcaaaaatatttgatactgattacatgttgaaatatatgtgttgggttaaataaaatgcattaaagttaaaaaaaaaaaat

SEQ ID NO: 284217 - DNA, 1480 bp, Homo sapiens
gaacatctctgcttccacccaaaaccacagcctttgaatattatataaggaacttaatggatagatatgtttattatttttgatagcacaactgctttctctgctattataaggaaaactgagaatagcaggtgggtagggtaggatgaggaaacaagatgcccaaagcctagatgccacagaattcatggtgataatcagggcatattttgagtcctactagaaacaaacattccaaatgaactctgaatgcctgactcaggcgttttggaggtttgggttatccccttgtcattaggcacacaagggttttttgttgtttttgttttttgggtttttgttttgttttgaggcagtctcgctatgttgcccaggctggtcttgttcctgggctcaagcagtcctcccgcctcggtctcccaaagtgccgggattacaggtgtgagccactgtgcccagcttatccttttttcattacacaaaaagactgaatttggttagttctaagttggaagataaagatggtatgcacaggaggcccttgggagccctcagataactttctcattcttccaagaataaggtaaggaagatgtcagcaagtcagcctctggtttacctgctagctggcatggatccttaaggaagcaggagggagttgggaagagaggaaggggtgaagttggtatcttttaaagcgagagtgattttacctcagattttgaagaatactaaggaatccagttgttggggtacatgctattattagaaggatctagataatttgtcctctgagtcatacttgacattgtacctgtggcacatcaatccgcactgtttgatactctggctgaatctcagctttcaccaacattgtcaaaggaccttttttagtgcccagccatgcctaagagtgtgtcatctgaagagggaagcatctgcatactgctgtcctgattgctcagtcctcactacctaccagacccgttggtaaggtacaaaagtacatgcttggaaaagcagtctgcaccaccagtgataagctgtgacagagtggaacagcctcaatgaaatgaaggaaggattgctacagtggcattaaggatggtctcttaatcctgtgttaaccactagattaactttacaatcaactcaaaatccttcaaaggctttccactttctttagtggcattcagaccccctctagtttgacccctacctccaacttgaacctctgttactcttccgtatgaacattttcctctagccctggactactagtaccgaagtcactagtcacataggactcatttgaaatatgactagtctcaattgagatgtaatgtaagtgtaaaatacacagcagatttctaagacagcacacaaaatgtaaaatatgtcaaaaatatttgatactgattacatgttgaaatatatgtgttgggttaaataaaatgcattaaagttaaaaaaaaaaaat

SEQ ID NO: 284218 - DNA, 538 bp, Homo sapiens
cctactactactactactacacccgcggccggtgcgacagacccgttggtaaggtacaaaagtacatgcttggaaaagcagtctgcaccaccagtgataagctgtgacagagtggaacagcctcaatgaaatgaaggaaggattgctacagtggcattaaggatggtctcttaatcctgtgttaaccactagattaactttacaatcaactcaaaatccttcaaaggctttccactttctttagtggcattcagaccccctctagtttgacccctacctccaacttgaacctctgttactcttccgtatgaacattttcctctagccctggactactagtaccgaagtcactagtcacataggactcatttgaaatatgactagtctcaattgagatgtaatgtaagtgtaaaatacacagcagatttctaagacagcacacaaaatgtaaaatatgtcaaaaatatttgatactgattacatgttgaaatatatgtgttgggttaaataaaatgcattaaagttaaaaaaaaaaaat

SEQ ID NO: 284219 - DNA, 326 bp, Homo sapiens
ggccacaggagctctggccaaggccccaggagtcaagaagtgcacagagggcatggatgcgttggaaaggggaggtgctggccttttaaagatcatatggcttggacaaggaacatgagcactgagatctgctataatcaacactcttattggaagcattactgttccgtgaaaaatcgcctgtgcctgggcttctcttgcatgctgcagacctcctattgttttctaatgccacgccgaagaaatgctcatctatatttgtttttgttagatcagccaaagacatagcaaacaacctaataaaagaaaagtaaaacctaaaaaaa

SEQ ID NO: 284220 - DNA, 599 bp, Homo sapiens
caggaagaagctcagcagcaccagcgtgaccaacagctgggtgacgaaagtccacatcctcgcctcctcaccagcccggtcctctggcagccagggccccggcaccacgggggcctgcctctcattctccactgggactcctgagtccccagggaccccttgcattccccctccctatctctctggtttgctctcttggtctctcactgtttctctctctgtgggcaggacaccgaatggccctctcggctgaagcagcccggcccaagtgcccttctgcccagcagccaggctctgccctgagtggcccgggtgacatcacgctcctataattttacctccccaaaccagctgccggagctgtccaaccgggctagaaggaagccggcaggtgcccatgtcctgagcactgaaagcacaagtgaaagtcactgtgtgagtgacacccgctgctgcctaaccccgccctgcccagagacctggaagtgggggctcggcctctcgcctatcctgcccatccccatgggaactagaaagagttctgcccagggaaagtttcttactttcagaaaataatacagtccgagaaagcagctact

SEQ ID NO: 284221 - DNA, 476 bp, Homo sapiens
ggaggtgcagacacactgcccaccagggagaagagagactggagagagagctcataaagagcactttgcagtatagaaaagcccttcgacaggcagcatcacccagaatgtgacttgcttgaaaccccagagccagttggtgacagaaacaggacgatccgggtgcaatcccatggctgcacgcctgctatcccagcactttgggaggccaaggccggaggaccacttgagcccaggagttcaagaccaatttgggcaacatagcgagcccccatctctacaaaaatttttttaaaatagccaggcatggtggtgtgtgcctgtagtaccagctactcagaaggctgaggcaggaggatcacttgagcccaggaatttacagtaagcccaggttacagtgagccatgagcatgccactgcactccagcctggactaaacagcaagacttcatctctaaaaacaaaagaaaaaagag

SEQ ID NO: 284222 - DNA, 1019 bp, Homo sapiens
agcgccgagcggccgctggccgcggctgctggcggcgaggacgcggcggcggccggaggcgggggcggtccgggggcggccgaggaggaggccctggagtggtgtaagtgccttctggcgggcggcggcggctacgacgagttctgcgcggcggtgcgggcctacgatcccgcggcgctctgcggcctggtctggacagccaacttcgtggcctaccgctgccggacgtgcggcatctcgccctgcatgtcgctgtgcgccgagtgcttccaccagggcgaccacaccggacacgacttcaacatgttccgcagccaggccgggggcgcctgcgactgcggggacagcaacgtgatgcgggagagcgggttttgcaaaaggcatcaaattaaatcaagttcaaatattccctgtgtccctaaagacttactgatgatgtctgaatttgttcttccaagatttatattttgtcttattcagtacttaagagaaggctataatgaaccagcagctgatggaccatcagaaaaggaccttaacaaagtccttcagcttttggaacctcaaatttcctttttagaagacctgactaaaatgggaggagcaatgcggtctgttcttactcaggttttgacaaaccaacaaaactacaaagatctgacttctggtcttggagaaaatgcttgtgtaaagaaaagtcatgaaaagtaccttatagctttaaagagctctggacttacatatcctgaggataagcttgtatatggtgtgcaggagccatctgctggtactagttctctggctgttcaaggtttcataggcgcaacaggaactttgggacaagtggattcttcagatgaggatgatcaggatggtagtcaaggtctgggcaagagaaaaagggtaaaactaagcagtggcaccaaagatcaatccataatggatgttttgaagcataaaagcttcctagaagaactattattttggactataaaatatgaattccctcaaaagatggt

SEQ ID NO: 284223 - DNA, 630 bp, Homo sapiens
gggtgtgtgcggaacatggcggagcgcggcaggaagcggccgtgcggcccgggtgaacacggccaaaggattgagtggcgaaaatggaagcaacagagatgttcttttatccagagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggctaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcaggtaacgctgtgtgggcccgcccccccatttcccctggatcatgccacagacactgagaccacccagtcctaccctgcgctgtccaggtgg

SEQ ID NO: 284224 - DNA, 1689 bp, Homo sapiens
gggtgtgtgcggaacatggcggagcgcggcaggaagcggccgtgcggcccgggtgaacacggccaaaggattgagtggcgaaaatggaagcaacagagatgttcttttatccagagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggctaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggcttctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggaagccatcctcatctccctggccgccctgcagcctggcctcacccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcga

SEQ ID NO: 284225 - DNA, 1837 bp, Homo sapiens
gggtgtgtgcggaacatggcggagcgcggcaggaagcggccgtgcggcccgggtgaacacggccaaaggattgagtggcgaaaatggaagcaacagagatgttcttttatccagagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggctaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggcttctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcacccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcga

SEQ ID NO: 284226 - DNA, 492 bp, Homo sapiens
atctttccaattcccagtccctctgcctagaatgcatccttattgtgaaaggaatacatcagcttagcacaattcaacattctctgactctgatttcccttgttctgattccagtcccaccaatccaacttgtactgattactttcttttccagtgtaggttagctcatgggaagagaatgcattattcatgtcctctcaaatatactggttgccctgacagttgtttcttattgtatgaactggacttgaggcaatgggctggagctgcaggtgcttatacttctgtttctgggacagatctgtttctttttgaacattgatactattttggttttataaatcagtcttgtcaacttagttactgtgactccaccccagcagtcttcagtatgctaatctagtgcctaagctaaaaggttgagggtcagctcctgaccctggtgaattgtgcattaaagccgcttagaaaccagcgtgccaaccccctgct

SEQ ID NO: 284227 - DNA, 1921 bp, Homo sapiens
attcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggtatgcagataatagccacacagaaaaaattttacatctcaaaacacctattccagaaaataaatgaataaagtattcaaacttagaaaaagagcaacaacacaaaaccttagccaaacaggaagaaggaaactataacagaaagaaatttacactttcaaaactgtacattataatttaaaagtaaatcaggccaagtgcattggttcacgcctgtaatcccagcattttgggaggccaaggcgggcagatcacgagatcaggagttcgagaccagcctgaccaacatggtgaaacctcatctctactaaaaatacaaaaattagctgggtgtggtggcgcgtgcctgtaattccagctacccaggaggctgaggcaggagaatggcgtgaacctgggaggcggaggctgcagtgagctgagaccacgccactctactccagcctgggcaacagagtgagtctctgtctcaaaaaaacaaaaaatttttttaaagtaaatctaagagctaattatttgacaagtccaattagataaactgccaactatctaataatgggaaaagaaaggggttaaacttcgacacaaaatgtggaagaaggccaggcgcggtggctcacacctgtaatcccagcactttgggaggccaagatgggtggattacctgaggtcaggagttcgagaccagcctggccaacgtggtgaaaccctgtctctactaaaaatacaaaaaattagctgggtgaggtggtgggtgcctgtaatcccaacgggaggctgaggcaggagaatcgcttgaacccaggaggcagaggttgcagtgagccgagatcgtgctattgcagtccagcctgggcaacaagagcgaaactctgtctcaaaaaataaataaataaataaatgtggaagaaatgtaaagactgtatatttctgctaataaatttgaaaacct

SEQ ID NO: 284228 - DNA, 353 bp, Homo sapiens
ccacaggtaagaggcagccactgctttatttttatttcttttataaggacagtggtagggggtggttgagagctgacaaaatgcgacaggttctttagttggatagaaacacagtggaagccacacgtgagaatttcaattttctatcagccacataaaaataagtaaaaagaaactggtcagcctgtctctacaaaaaaattaaaaagtagctgtggtggcgtgttcccgtggtcccatctactcgggaggctgaggtgagaggatcgcttgagcccgggaggcagaggttgcagtgagctctgattggaccgctgcactccagcctgggcaacagagagaaaccctgtctc

SEQ ID NO: 284229 - DNA, 929 bp, Homo sapiens
tgttgtcccacaagtaggctgatttctgatcgcacagatgggtcagagtaaaaccttctattcttgagcctgtgccccgcgacactgaacttcacaagtgcttctcagttcttccttctcctctcacttggcgggacaagatgaatagaggaagatgatgggggatacatctctttccacaggactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagtttctctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaaccgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacagg

SEQ ID NO: 284230 - DNA, 830 bp, Homo sapiens
gggagtacctgtacctttcagctgcgccggccgcgaggccacggagagctcgccttggagagcccaggagcaggggagacatggactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagtttctctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaaccgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacagg

SEQ ID NO: 284231 - DNA, 803 bp, Homo sapiens
tgttgtcccacaagtaggctgatttctgatcgcacagatgggtcagagtaaaacctgactcagtggtctttgaggatgtggctgtggacttcaccctggaggagtgggctttgctggattctgctcagagggacctctacagagatgtgatgctggagaccttccggaacctggcctcagtagatgatgggactcaatttaaagccaatgggtcagtttctctgcaggatatgtacgggcaagaaaaatctaaggaacagacaataccaaacttcacaggaaataattcctgtgcctacactttagaaaaaaattgtgaaggctatggcactgaagaccaccacaaaaatctgagaaatcatatggtggacagattctgtacacataatgaaggtaatcaatatggagaagccatccatcaaatgccagatcttaccctgcacaagaaagtttctgctggagaaaaaccatatgaatgcaccaagtgcaggacagtcttcacgcatctttcttctcttaaaaggcacgtcaagtctcactgtggacgaaaagcacctccaggtgaggaatgtaagcaggcctgcatttgtccctcacacctacacagtcacggaagaaccgacactgaggagaagccgtataagtgtcaagcatgtgggcaaactttccaacatcctcgttacctctcccaccacgtaaagactcacacagcagagaaaacctacaaatgcgagcagtgtcggatggcgtttaatgggttcgcaagcttcactagacatgtgagaactcacacaaaagacagg

SEQ ID NO: 284232 - DNA, 920 bp, Homo sapiens
  misc_feature (587)..(587): n is a, c, g, or t
  misc_feature (911)..(920): n is a, c, g, or t
tgtctgtcagagctgtcagcctgcttaagcagagtaaaatggtacaggcagtgcagcctggtagcgagaaaaaaggctgcctgtgaaatcccactgtgggaccataagtggggacctcagggccccttcatggcatctccatggccatgtcatgctggagaaggaggcgtttcaagaatgtgagctgatcgctggaaactgctcatctgactccagtctcaaaagaggctatgtgcaagaatcgggtgaagttgtgagaccccatccacccctcacaagattgtatccccaccctgtctgaccttactgctgctcaaactatctgtccaaggatgaaaacccaggacaaaggaggagtaaccctcatgatgtgaagcacgtgttcacctgtgaatataacctgaggatcatgagactatctgtggatttcacagagaagacagacgagaagacaccgctgacacttctccacggaggtctccttttccaccaagatgcagatgcttcttgcaaggactatcctgtgaatcccacagagaagacaggtgtggttccaatgccggtgcacctccagggaattctccttntctaccaagctccaggccttctgccatgatcatgagactatttgtggatttcacagagaagataggtgaaggtacagcatggcatccacccctcaccagaggggtatccccacccctatctgaccttattaccttattgctgttcaaagtctctatcccagactgaaatcccaagacaatggagaagttccccctgatgatgtgaagcaccaactcctctgggaatcaaattcgaggtaaatttaataggcccggtagagatgaatgatagtgtctctccttggattggctgaaagacaattaaacactggtatatttctgttnnnnnnnnnn

SEQ ID NO: 284233 - DNA, 717 bp, Homo sapiens
tctacccttcctatggaaaagggacacatttgacaactcttgaacctgctttgttgctcttagttctgtagcattcttagcaaacagggattcttacatttgatatatggaaatgtcagcctatgattttctattcttaaggcacataacattaaattagaagaaatacttaaaacttgaagaaaatattcttcacagttttaagctgtattcagattatagctcagaaaaacatgtttccagttcacaaaccatttgttcaaaataaaacccacaagttacaaatagaataaaaatcatgattattttaatcaaaagaaatctgactgactagcatatgtgatttctcttcctggctttcctcattttaagtatgtgtgtttgtgtgcatgtgcacacacctgtgcaaaggtgtgtttatggtggacaaagggattttaggcagtagccacaggaactgagttggttctttcagttatctaacggcaatcccaattttaggattcctcttcctaaactggaatctcagggacaagcttgcatagctaaagaaaaaaacactgaacatgaactataataacagggtttgggtttttttgttttgttttgagacagggtctcactctgttgcccaggcaggggtacagtgatgctttctcagctcacgctagttcatcgcgagcggccgcacaactttgtacaagaaagttgggtttt

SEQ ID NO: 284234 - DNA, 1012 bp, Homo sapiens
tcaggacaaatcagggtggtgaccttggccacatcactgtcatagagcttcttcacagcctgtctgatctggtgcttgttggctttaacatccacagtgaacacaagcgtgttgttttcttctatcttcttcacggccgactcagtggtcagcggaaacttgatgatagcatagtggccaagcttgtttctcctgggggtgctcttccgaggatatctgggctgcctccggagtcgcagtgtcttgggccgcctgaagatattatttccccctgatgctttcctgaaagctcctgcaatcaactacaggtcagaatgttcgtctccaagacaggactccccctgagactcacagaaaagactatgacaggtactctggttataggcttctgatgatattgcttaaataactttaagaccatacacttgactcagttaaggtctccagaagtccggttgggaaactgatgggttcatgacactgctaactcaagatccacaagactggaattgattacatggcactgaatgaactgatgaaaattgattataattgtatagctttttggagcattgctggttaatattctagtttctggatttaagaaatctctttctcttactctaactgtaacttacaacaatttagtagattatacttttgtaaacagaaatgaagcgtttatctttttcttgcctgatttttccagaattttgaaatccttactgaatactcttatttccacgatgatattgttgttagcaaaagtccaataagaatctattcatcttataacaggacataattggaaattttggttatattatcaaggtttttactggaatatcatatttagggagtgtacctaagatcagttatgaccagcaattttaaggaagtaaggttgacttttatggagacaatgcttacaaagcactgtggaaaactttgaggaaagttcttcctcaaagattataaagtcacaactacccactatttttatatgtatgtg

SEQ ID NO: 284235 - DNA, 751 bp, Homo sapiens
gagccatgaaagacttaagtatttttctatataaacttcagaattcaataatgtcagtgtatatctttaaaacaaatttctcagttaaaaccaaataggacatagtgatttactttaaacgtcaagcatctttcagatcaaactgtcatatgttgtgttgccaggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacaggtaaaattactttttaatatgttcaaagtaattcattttaaattttccagtaaatagtaaagtcactcactttaatttttaaaaaatgaaa

SEQ ID NO: 284236 - DNA, 630 bp, Homo sapiens
tagccgagcgtggtggcagcgcctgtagtcccagctactcaggaggctgaggcaggagaatggcgtgaacctgggaggcagagcttgcagtgagtggagattgcatcactacactctagcctgggcgacaaagcgagagtctgtctcaaaaaaaaataaaaaaataaagatgtttgtcatctttttgctaaataaataattaaaaacctaatgtattttgtgctgcaaattgacaacagcaagaaggtgaaaaggctttacccacaagatgggagaaacatttgcacatcatatatccaataaaggacttgtatccagcatgtataaagaactcttataattaaaaatgagcaaatgtcttttagttattcagccataaaaagaaatgaaatattaacaaatgccacagtccttgaaaccattctgttaaagttaacctcctttgatttctgcgggtgttgtaatgaactcctcagtacctcaacattcaatttatgttttgtctacttggcttagcttaccataaaagttttgtcattgatgctctctataagcttagctttaaattctaaaattcagccttatcctgaaacagcaaggaaaagccatcttaggattcatccctagcac

SEQ ID NO: 284237 - DNA, 4201 bp, Homo sapiens
tgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatgggcttgcgcgtgcggcggctgggcaccgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaagaacgaaatgttgaagatctttcaggaggagagttgcagagatttgcttgtgctgtcgtttgcatacagaaagctgatattttcatgtttgatgagccttctagttacctagatgtcaagcagcgtttaaaggctgctattactatacgatctctaataaatccagatagatatatcattgtggtggaacatgatctaagtgtattagactatctctccgacttcatctgctgtttatatggtgtaccaagcgcctatggagttgtcactatgccttttagtgtaagagaaggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctggattgtcttaaagaaagtacttgtgatataagagcacagttctacttactgctaatgacagaatatgtattaaacgtattttcatgtaaatgaaatctttaaaatatgtatcttaaaattttacatagcaacagaaaggcctacaattgctaacacaagaaaaatacttataaaatcagtataaaatcaatgcagatgttagcaaaagaatgagactacttcatatgtcctaattggaaaaagtctcaaatacttaaaaaaacaaaaaactggaacagtttattatactaccatttttgtgaaaatatacaaaatattgaaataaaggaatactcaagaaacagaaaactt

SEQ ID NO: 284238 - DNA, 4128 bp, Homo sapiens
tgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatgggcttgcgcgtgcggcggctgggcaccgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaagaacgaaatgttgaagatctttcaggaggagagttgcagagatttgcttgtgctgtcgtttgcatacagaaagctgatattttcatgtttgatgagccttctagttacctagatgtcaagcagcgtttaaaggctgctattactatacgatctctaataaatccagatagatatatcattgtggtggaacatgatctaagtgtattagactatctctccgacttcatctgctgtttatatggtgtaccaagcgcctatggagttgtcactatgccttttagtgtaagagaaggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttaaaaaaaaaaaaaaaaaaaaaaaaaaaaaaaaaaaaaaaaaaaaaaaaaaaaaacaaaaaaaaagaatcgcaccccaccaaccaagaaaaaaataaacctccacagaaggacacaccaacatttaagcaaggaacacaccgctccaagcgaagcaaaccgggaccccatcaacaagccccatgactaacaacacagaaacacacggccacacttaacacagctcgcatcggcgtcacatcctcccgtaccctcctagaacgaatccaacgtgggatgaaaacaagtga

SEQ ID NO: 284239 - DNA, 4108 bp, Homo sapiens
tgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatgggcttgcgcgtgcggcggctgggcaccgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaagaacgaaatgttgaagatctttcaggaggagagttgcagagatttgcttgtgctgtcgtttgcatacagaaagctgatattttcatgtttgatgagccttctagttacctagatgtcaagcagcgtttaaaggctgctattactatacgatctctaataaatccagatagatatatcattgtggtggaacatgatctaagtgtattagactatctctccgacttcatctgctgtttatatggtgtaccaagcgcctatggagttgtcactatgccttttagtgtaagagaaggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataaaaaaaaaaaaaaaaaaaaaaaaaaaaaaaaaaaaaaaaaaaaaaaaaaaaaaacaaaaaaaaagaatcgcaccccaccaaccaagaaaaaaataaacctccacagaaggacacaccaacatttaagcaaggaacacaccgctccaagcgaagcaaaccgggaccccatcaacaagccccatgactaacaacacagaaacacacggccacacttaacacagctcgcatcggcgtcacatcctcccgtaccctcctagaacgaatccaacgtgggatgaaaacaagtga

SEQ ID NO: 284240 - DNA, 3613 bp, Homo sapiens
tgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatgggcttgcgcgtgcggcggctgggcaccgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaagaacgaaatgttgaagatctttcaggaggagagttgcagagatttgcttgtgctgtcgtttgcatacagaaagctgatattttcatgtttgatgagccttctagttacctagatgtcaagcagcgtttaaaggctgctattactatacgatctctaataaatccagatagatatatcattgtggtggaacatgatctaagtgtattagactatctctccgacttcatctgctgtttatatggtgtaccaagcgcctatggagttgtcactatgccttttagtgtaagagaaggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgcctttcggagaagaggggatcctctaggtcgactagac

SEQ ID NO: 284241 - DNA, 3382 bp, Homo sapiens
tgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatgggcttgcgcgtgcggcggctgggcaccgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctggattgtcttaaagaaagtacttgtgatataagagcacagttctacttactgctaatgacagaatatgtattaaacgtattttcatgtaaatgaaatctttaaaatatgtatcttaaaattttacatagcaacagaaaggcctacaattgctaacacaagaaaaatacttataaaatcagtataaaatcaatgcagatgttagcaaaagaatgagactacttcatatgtcctaattggaaaaagtctcaaatacttaaaaaaacaaaaaactggaacagtttattatactaccatttttgtgaaaatatacaaaatattgaaataaaggaatactcaagaaacagaaaactt

SEQ ID NO: 284242 - DNA, 2829 bp, Homo sapiens
aagcagtggtatcaacgcagagtcgccattacggccggggattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctggattgtcttaaagaaagtacttgtgatataagagcacagttctacttactgctaatgacagaatatgtattaaacgtattttcatgtaaatgaaatctttaaaatatgtatcttaaaattttacatagcaacagaaaggcctacaattgctaacacaagaaaaatacttataaaatcagtataaaatcaatgcagatgttagcaaaagaatgagactacttcatatgtcctaattggaaaaagtctcaaatacttaaaaaaacaaaaaactggaacagtttattatactaccatttttgtgaaaatatacaaaatattgaaataaaggaatactcaagaaacagaaaactt

SEQ ID NO: 284243 - DNA, 2646 bp, Homo sapiens
aaaacatgtcatagatggtggatacacattgatatctgttggtggcaaattgatatacttttattctgaagcttaactttgtcaagattcataaatagaagagttctatagtgaaagtttatcatttaaatacttttttatattaaaaacagggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctggattgtcttaaagaaagtacttgtgatataagagcacagttctacttactgctaatgacagaatatgtattaaacgtattttcatgtaaatgaaatctttaaaatatgtatcttaaaattttacatagcaacagaaaggcctacaattgctaacacaagaaaaatacttataaaatcagtataaaatcaatgcagatgttagcaaaagaatgagactacttcatatgtcctaattggaaaaagtctcaaatacttaaaaaaacaaaaaactggaacagtttattatactaccatttttgtgaaaatatacaaaatattgaaataaaggaatactcaagaaacagaaaactt

SEQ ID NO: 284244 - DNA, 2583 bp, Homo sapiens
tagccgagcgtggtggcagcgcctgtagtcccagctactcaggaggctgaggcaggagaatggcgtgaacctgggaggcagagcttgcaggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctggattgtcttaaagaaagtacttgtgatataagagcacagttctacttactgctaatgacagaatatgtattaaacgtattttcatgtaaatgaaatctttaaaatatgtatcttaaaattttacatagcaacagaaaggcctacaattgctaacacaagaaaaatacttataaaatcagtataaaatcaatgcagatgttagcaaaagaatgagactacttcatatgtcctaattggaaaaagtctcaaatacttaaaaaaacaaaaaactggaacagtttattatactaccatttttgtgaaaatatacaaaatattgaaataaaggaatactcaagaaacagaaaactt

SEQ ID NO: 284245 - DNA, 2571 bp, Homo sapiens
tgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatgggcttgcgcgtgcggcggctgggcaccgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaagaacgaaatgttgaagatctttcaggaggagagttgcagagatttgcttgtgctgtcgtttgcatacagaaagctgatattttcatgtttgatgagccttctagttacctagatgtcaagcagcgtttaaaggctgctattactatacgatctctaataaatccagatagatatatcattgtggtggaacatgatctaagtgtattagactatctctccgacttcatctgctgtttatatggtgtaccaagcgcctatggagttgtcactatgccttttagtgtaagagaaggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggtatgtagaaaagttgtcttaaatcatggattactgatctcagtataaacacttgaaaggctatttaaaaatcaataacatatggctgggcacagtggctcacacctgtgattcaagcacttttgggaggccaaggcaggcagatcacttgaggtcacgagtttgagaccagcctggccaacatggtgcaaccccatctctactaaaaatgcaaaaattagccgagtctggtggcaggtatctgtaatcccagctacttaggagtctgaggcaggagaatcacttgaacctggaaggtggaggttgtagtgagctgagatcatcccactgtactccagcctgggcaaaagagtgagactctgtctaaaaaaataa

SEQ ID NO: 284246 - DNA, 1594 bp, Homo sapiens
tggatcaccataaaaaacgatgacgcgatccgctagataggtggcatgatgaagtcatgttccacaacaaaggctgtcttttttgcatggagtatgaaacgtttgacaactcgagctgccatcagtctttgctcagaatccaaatatgtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctggattgtcttaaagaaagtacttgtgatataagagcacagttctacttactgctaatgacagaatatgtattaaacgtattttcatgtaaatgaaatctttaaaatatgtatcttaaaattttacatagcaacagaaaggcctacaattgctaacacaagaaaaatacttataaaatcagtataaaatcaatgcagatgttagcaaaagaatgagactacttcatatgtcctaattggaaaaagtctcaaatacttaaaaaaacaaaaaactggaacagtttattatactaccatttttgtgaaaatatacaaaatattgaaataaaggaatactcaagaaacagaaaactt

SEQ ID NO: 284247 - DNA, 1049 bp, Homo sapiens
cgactctacaggatctcctccaccgctctccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctggattgtcttaaagaaagtacttgtgatataagagcacagttctacttactgctaatgacagaatatgtattaaacgtattttcatgtaaatgaaatctttaaaatatgtatcttaaaattttacatagcaacagaaaggcctacaattgctaacacaagaaaaatacttataaaatcagtataaaatcaatgcagatgttagcaaaagaatgagactacttcatatgtcctaattggaaaaagtctcaaatacttaaaaaaacaaaaaactggaacagtttattatactaccatttttgtgaaaatatacaaaatattgaaataaaggaatactcaagaaacagaaaactt

SEQ ID NO: 284248 - DNA, 231 bp, Homo sapiens
tttgcttgtgctgtcgtttgcatacagaaagctgatatgtaggttactttacaatttttgtttatcttcatccgtattgtagagttttcagttgtgatgctgctaatagaggaatggttttgagagaaattaatagaaatagtatctaagttcctaatttcgaggtaagatgttgaagcagttgtgtatccactactcattttccctgttatattcacaggggaaaatatt

SEQ ID NO: 284249 - DNA, 190 bp, Homo sapiens
gatcctcctgactggcaggagattttgacttatttccgtggatctgaattacaaaattactttacaaagattctagaagatgacctaaaagccatcatcaaacctcaatatgtagaccagattcctaaggctgcaaaggtcggtttttgatagagggaacttaacggatattagtagaagtataaaagat

SEQ ID NO: 284250 - DNA, 418 bp, Homo sapiens
tttcatgtttgatgagccttctagttacctagatgtcaagcagcgtttaaaggctgctattactatacgatctctaataaatccagataggtaagtagagatctggcatattactgtgttgttttgtttggagatttttacagatttctaaggattaaacactgggactgtcaatgtgatgtacatattttttatcttggttgtttatagctgccacctaaatttacctttctttacctagaacagaggttctcaatgcaagattcatttattaacacccccgcttccagggagcttaggaatattctgaaattatatgcaaattccgtagctttataggaagcagacccttagcttttaccagctatctttttctctctctctgtctctcattttcacacacacaacacacgcacgc

SEQ ID NO: 284251 - DNA, 324 bp, Homo sapiens
atatatcattgtggtggaacatgatctaagtgtattagactatctctccgacttcatctgctgtttatatggtgtaccaagcgcctatggagttgtcactatgccttttagtgtaagagaaggtaacttgaaaaacttttttcacatatgctgtattctcttctactctaatgcttataaactacattattgatattaagtagttttacattggtctgatatcatccaaaactctagttccttggaatttaatcactgagcatataaggttatatatatcagttgttatacaaaatatatttttttcattttggagaattttct

SEQ ID NO: 284252 - DNA, 1134 bp, Homo sapiens
  misc_feature (25)..(25): n is a, c, g, or t
caaaaagactggtcaactggatttncattcccagaaaccaggaaatttctgaaactgagttttaaacctggcaactcttttaccatccctttgtatttttgcagttcctccctataccagcttccttacagctgttctgatttcctgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttgg

SEQ ID NO: 284253 - DNA, 1149 bp, Homo sapiens
attctgtctttcacatacattgagaccaaaaagaccaagtacctataagaggaccaacccagacgggctgtgacaattacgctgttgcttctgagtgagaagttacaggcccaagaaagggtaatgacagccttagagatacataaaagagacaagcaatttccaaaacaaaaagcaaaggcaaaaagaaaaataaaaaagcaggcctttggagctctcagctttggagtcagttaagaccagttccttgctgggaagccctaactctggagggacagagacaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttgg

SEQ ID NO: 284254 - DNA, 1247 bp, Homo sapiens
tgttgttgttatttttgagacagtgtctccctctgtcacccaggctggagtgcagtggtgtactcatagctcactgcaacctctgcctcctaggctcacgagatcctcccacctcagcctctctaatagctgggactacaggcatgggtcaccacgcttggctaattttttaaggttttgtagagacagggtctccctatgttgctcaggctggtcttgaactcctgagctcaagtgatcctcccaccttggtttcccaaagtcctggaaagtgctggaattacaaacatgaatcactgtgcctggcctaaaatgtatgtttttctaaaaaaaaaaaaaaaaaaaaatcagagaatataaatactaaaaaacaaacatagaagtgcagaaatataaagacttagtgtatagacccttaaagccccctaattaactcagagtcatgtggcctcactggcatttcgatctcgttatataccttcaatgcactttgcaggcaactctcatatttttctgatgaaaagcaattgctcctttttagccccttcgctaagatttatttgcaggtgtctctcattttctactcctttttagagcttagatgccagatgcctttttaggttattgaatgataaagtgcttctatcactctccccacccaaaacctgggtgtgtaaacacctgattcagaatttctcacttctctatgttttatgggttgactcatcacttgggtcctctcctacctccaggaaaatggttttactttgaactgctttgtaataccgagataacttaagcatgcattgaggctcaagggcagggaggtggattccatcacagcatgaaatactgaaatacaactacacaaaaccagtctccattacccaattcagaaagtggaaaagctaagccttgttctaatttctgttcaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttgg

SEQ ID NO: 284255 - DNA, 781 bp, Homo sapiens
  misc_feature (25)..(25): n is a, c, g, or t
caaaaagactggtcaactggatttncattcccagaaaccaggaaatttctgaaactgagttttaaacctggcaactcttttaccatccctttgtatttttgcagttcctccctataccagcttccttacagctgttctgatttcctgtcgtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtaattttgcatagtagggactgtcgatccttctgggaattcacttcattggctatttctgcacgttataactttaccctacgatcccccattcgcttttactgtgactaaggttctaccttatggcgtcccggaccactcctctttactgggtactgccccttcgcccttccccg

SEQ ID NO: 284256 - DNA, 382 bp, Homo sapiens
  misc_feature (25)..(25): n is a, c, g, or t
  misc_feature (287)..(287): n is a, c, g, or t
  misc_feature (289)..(289): n is a, c, g, or t
  misc_feature (373)..(373): n is a, c, g, or t
caaaaagactggtcaactggatttncattcccagaaaccaggaaatttctgaaactgagttttaaacctggcaactcttttaccatccctttgtatttttgcagttcctccctataccagcttccttacagctgttctgatttcctgtcgtgtctgagctgggtgaattccagcctggggagaggactttgatcctccactccagagcacctgagaaggccgggcccagaggccctgtgtgatgtgtactccgcagctgtttggggtgggacatttctgtacttctngntttgcttatggctcagcattacctgtgtcagtccatgattctgttgtaacagttttaagggtaaataaataaaggctgcctgantgtccccaa

SEQ ID NO: 284257 - DNA, 1356 bp, Homo sapiens
tgttgttgttatttttgagacagtgtctccctctgtcacccaggctggagtgcagtggtgtactcatagctcactgcaacctctgcctcctaggctcacgagatcctcccacctcagcctctctaatagctgggactacaggcatgggtcaccacgcttggctaattttttaaggttttgtagagacagggtctccctatgttgctcaggctggtcttgaactcctgagctcaagtgatcctcccaccttggtttcccaaagtcctggaaagtgctggaattacaaacatgaatcactgtgcctggcctaaaatgtatgtttttctaaaaaaaaaaaaaaaaaaaaatcagagaatataaatactaaaaaacaaacatagaagtgcagaaatataaagacttagtgtatagacccttaaagccccctaattaactcagagtcatgtggcctcactggcatttcgatctcgttatataccttcaatgcactttgcaggcaactctcatatttttctgatgaaaagcaattgctcctttttagccccttcgctaagatttatttgcaggtgtctctcattttctactcctttttagagcttagatgccagatgcctttttaggttattgaatgataaagtgcttctatcactctccccacccaaaacctgggtgtgtaaacacctgattcagaatttctcacttctctatgttttatgggttgactcatcacttgggtcctctcctacctccaggaaaatggttttactttgaactgctttgtaataccgagataacttaagcatgcattgaggctcaagggcagggaggtggattccatcacagcatgaaatactgaaatacaactacacaaaaccagtctccattacccaattcagaaagtgggagcagcaatgcgttgatggggagtggagcagtgcacttccagtctgcaagttgatccaggaagctcccaaaccagagtgtgagaaggcacttgtaagtaggaggctcatatctgtcttgttcacagctggatctccagggcctggcatcactcctggcatatgctcagtatatatctgtttaatgtgggacattttgcttttgaatgggttggccttggcctggctgtagaagggactcataaactattaactcacatttttataaatggaagttggaagttcccattcactaccatcatcacaaatacctcatgagaccctgttggtagaagttgttgtctcatgtgccttatagagcagtggttcccaacctttttggcaccagggatgggtatcatggaagatgacttttccacggatgggggtggggagagtggggatggtttgggga

SEQ ID NO: 284258 - DNA, 972 bp, Homo sapiens
gcaagcgagaacaatgtgtcacagcaggcctttggagctctcagctttggagtcagttaagaccagttccttgctgggaagccctaactctggagggacagagacaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttgg

SEQ ID NO: 284259 - DNA, 1083 bp, Homo sapiens
gtactgtcctcatgacagcgagtgagttctcatgagatctggttgtttaaaagtgtgtaacgcctcctccctctctcgttcctgcacctgttatgtgagatgcctccctccccctttgccttctgccatgattgtaagttttccgaggcctccccagaagccgagcagatgccagcaccatgtttcctgtacagcctgcagaactgtgagccaattaaacctcttttctttataaattacccagtctcaggtatttctgtatcacaatgtgagatggactaatacactcatgtttcacaactcttatccacaggggatgtcagcttccacttgagctcacacgcttcatctcctctctcagggagttatttcttcagccttcacctatggcccaatttttcttttcttgtacattaacaattagcttctctacaacttactcagaagatgggctgggggaaagctctttcccatggacaaatatgatttagaagagaaggaaatgaatgaagaacaggtttccagatcccgcaggtgttgctgtgaggatgtcaggtgctggcgcaggtgttgctctgaggctgtcaggtgctggcataaacagctgcaattaggggtgctgttcattgagcgtgcctggccctcataactatgacttctatactcgtctctctcaggggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttgg

SEQ ID NO: 284260 - DNA, 969 bp, Homo sapiens
  misc_feature (25)..(25): n is a, c, g, or t
caaaaagactggtcaactggatttncattcccagaaaccaggaaatttctgaaactgagttttaaacctggcaactcttttaccatccctttgtatttttgcagttcctccctataccagcttccttacagctgttctgatttcctgtcgtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttgg

SEQ ID NO: 284261 - DNA, 959 bp, Homo sapiens
gtactgtcctcatgacagcgagtgagttctcatgagatctggttgtttaaaagtgtgtaacgcctcctccctctctcgttcctgcacctgttatgtgagatgcctccctccccctttgccttctgccatgattgtaagttttccgaggcctccccagaagccgagcagatgccagcaccatgtttcctgtacagcctgcagaactgtgagccaattaaacctcttttctttataaattacccagtctcaggtatttctgtatcacaatgtgagatggactaatacactcatgtttcacaactcttatccacaggggatgtcagcttccacttgagctcacacgcttcatctcctctctcagggagttatttcttcagccttcacctatggcccaatttttcttttcttgtacattaacaattagcttctctacaacttactcagaagatgggctgggggaaagctctttcccatggacaaatatgatttagaagagaaggaaatgaatgaagaacaggtttccagatcccgcaggtgttgctgtgaggatgtcaggtgctggcgcaggtgttgctctgaggctgtcaggtgctggcataaacagctgcaattaggggtgctgttcattgagcgtgcctggccctcataactatgacttctatactcgtctctctcaggggactgtgaccctcctgggaatccagttcatggctattttgaaggaaataacttcaccttaggatccaccattagttattactgtgaagacaggtaagtgaacacagcctgtcaaatgccagatcttgccccttggcagcattgttttggggaataacccagtctgtgtccacctggtcatctgatttcctactgctgcaggattctaagctcattctgattttgagagctgctttggccctctgctagctctcctcaatccctagaagacagactgatcc

SEQ ID NO: 284262 - DNA, 690 bp, Homo sapiens
ctgtatcacaatgtgagatggactaatacactcatgtttcacaactcttatccacaggggatgtcagcttccacttgagctcacacgcttcatctcctctctcagggagttatttcttcagccttcacctatggcccaatttttcttttcttgtacattaacaattagcttctctacaacttaaaatttctttccttgagctcctgctgtcagataatactcccaaatccctactaactcagaagatgggctgggggaaagctctttcccatggacaaatatgatttagaagagaaggaaatgaatgaagaacaggtttccagatcccgcaggtgttgctgtgaggatgtcaggtgctggcgcaggtgttgctctgaggctgtcaggtgctggcataaacagctgcaattaggggtgctgttcattgagcgtgcctggccctcataactatgacttctatactcgtctctctcaggggactgtgaccctcctgggaatccagttcatggctattttgaaggaaataacttcaccttaggatccaccattagttattactgtgaagacaggtaagtgaacacagcctgtcaaatgccagatcttgccccttggcagcattgttttggggaataacccagtctgtgtccacctggtcatctgatttcctactgctgcaggattctaagctca

SEQ ID NO: 284263 - DNA, 1014 bp, Homo sapiens
  misc_feature (25)..(25): n is a, c, g, or t
caaaaagactggtcaactggatttncattcccagaaaccaggaaatttctgaaactgagttttaaacctggcaactcttttaccatccctttgtatttttgcagttcctccctataccagcttccttacagctgttctgatttcctgtcgtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttgg

SEQ ID NO: 284264 - DNA, 391 bp, Homo sapiens
atgagtagtcctgccccgactggcccatcctttccaggtgcagtcccccttactgtgtctgccaagggtgccagcacagccgccccactccaggggaagaggagtgccagcccttacccacctgagtgggcacagtgtagcatttattcattagcccccacactggcctgaccatctcccctgtgggctgcatgacaaggagagagaacaggctgagagtctcactatgttgaccaggctggcctggaacttctgagctcaagtgatcctcctgccttcgcctcccaaagtgcagagattataggtgtaaactatcacgcctggcctgtttacatagtttaataatgtaaatcttcaataccgatctaataaaaattgaaatatgcctttt

SEQ ID NO: 284265 - DNA, 1889 bp, Homo sapiens
tatttaatgaactagaatggcagtgatattactctcataacccggctcctgctgaatgactccctctaggatattttctagggttttatgccaatgaagtttttggttttatttgttgtaaatagcaagacttccattgttttaccaaaaaattttcagatcactcattttcactaaatttgtaaaataaaaacatatagggcatgttttagtacaatattttgattaaattaattttctatattaaaaatgcttggtttccaccttctagcaattaatattcgaagaaacaaaacattcgttctactagaatcagatgctgtgagttgattttggtagctatttgctgctctgcagacctaatttcaggctgctgtggttctcagcagcaatttgattttgtgaatattatcttttgtattctgaatcacattgctaagcagggtggtgttgtaaaaataaaaacataaggttctcttgtctgagtctgtgtgggagtcagcgatgcttatttctagcacgaaacattatctgtatggtgaatttcccgaatgctgtttgaccttggagttgttcatttaatgaaaaaaacttcaatgcctactatgtgcccagacctcttctaggtagagacgatacaagagtggtacagaagtgaacaacacaggtaagtggtctggcctacaaggatttcgcattctgggtattggagactgattttagcaggaacttaaaaagataatttcaggctgtgattagagctctggagtaaataacaaagagatatgataaaatgtaacctggggagtcaggcagtggctgaatggaggagggaggagacaacttcagagcatgagagggaagacttttctgaggccatgcctttaaggtgaggaacataagtaatcttttggagagctgggaaagttgttctggtacagggtaatatcaagtgcaaaggccctggggcagtgggcttgttgtatttgagaaacagcaggtgggtgtggccaaagcctaccaagagatgacactggagaagacaggagggtcctgtagtgtatgatacacaagcagccatttttacaaacaataactaaggcacctttccttttcagatggtggaattgcacgacttagagtattcggtactggacaaaaagactggactgcaactgaccccaaagaacctgcagacctagtggccatcgcttttgggggtgtctgtgtaggatttagtaatgctaagtttgggcacccaaacaatataataggagttggcggggcaaagtctatggcggatggttgggaaactgcaagaaggctggaccggccaccaatattagaaaatgatgagaatggcattctcttggttccgggttgtgaatgggcagttttccgattggcacatcctggagtaataactcgaattgaaattgacacaaaatattttgaaggcaatgctcctgacagctgtaaagtggatgggtgcatcctgacaactcaggaagaagccgtgatcaggcaaaagtggattctcccggcccacaagtggaaaccactgcttccagtgaccaagttgtctcccaaccaaagtcatctgttcgatagcctgaccctagagctccaagatgtcatcactcacgccaggctcaccatcgtccccgacgggggagtgagccgccttcggctccggggcttccccagctccatctgcctcctgaggccccgggagaagcccatgttgaagttctcggtgagcttcaaagcaaacccttaacacacacaaagccccggtgtcggacacacagcagtaatttcccagtcatagtcttcttttcaaatgttttgaacacctggtgatttaataaagtggtcgtctcacaaaa

SEQ ID NO: 284266 - DNA, 1419 bp, Homo sapiens
caagcaccgtgggaccttggctggcttctggggagcaagagatccatttatgaatacttgatttctgactgctgggaagcacggctgatgctccgaaggagggaagactgacccggtttctggacttcacccagctgatggacatggcatctgaatccgtaggaggaaaaattttatttgcaacagatgacttttttgctcctgcagaaaacctcataaagagtgacagcccgtgcttcaaagagcatgaatatacggagtttgggaaatggatggatggctgggagaccaggaggaaaaggattccaggtcacgactggtgtgtcctcaggctggggatccaaggagtcatccggggcttcgacgtggacgtttcttacttcacgggagattacgctcctcgagtgtccattcaagcagcaaacttggaagaagataaactaccagaaatcccagaaagaggaatcaggacaggagctgcagccactcctgaggagtttgaagccattgctgagctaaaatccgacgactggagttacttggttcccatgactgagcttaagccaggaaaccctgcttccggccacaactattttcttgtcaattcccagcagagatggactcatatcagactcaacattttcccagatggtggaattgcacgacttagagtattcggtactggacaaaaagactggactgcaactgaccccaaagaacctgcagacctagtggccatcgcttttgggggtgtctgtgtaggatttagtaatgctaagtttgggcacccaaacaatataataggagttggcggggcaaagtctatggcggatggttgggaaactgcaagaaggctggaccggccaccaatattagaaaatgatgagaatggcattctcttggttccgggttgtgaatgggcagttttccgattggcacatcctggagtaataactcgaattgaaattgacacaaaatattttgaaggcaatgctcctgacagctgtaaagtggatgggtgcatcctgacaactcaggaagaagccgtgatcaggcaaaagtggattctcccggcccacaagtggaaaccactgcttccagtgaccaagttgtctcccaaccaaagtcatctgttcgatagcctgaccctagagctccaagatgtcatcactcacgccaggctcaccatcgtccccgacgggggagtgagccgccttcggctccggggcttccccagctccatctgcctcctgaggccccgggagaagcccatgttgaagttctcggtgagcttcaaagcaaacccttaacacacacaaagccccggtgtcggacacacagcagtaatttcccagtcatagtcttcttttcaaatgttttgaacacctggtgatttaataaagtggtcgtctcacaaaa

SEQ ID NO: 284267 - DNA, 909 bp, Homo sapiens
aggctagacaaggagggctctgcaaacatatggcgtggcctggggctgtcagacagtagtgtcgctgcaggacacggaggagactggcagcgaggcagcagggtcggcaggagcccataaaggttctgatgacgcattcctcaggcccaatccgtagagcaggaggaatctaactggtgtccgagaagatgtgtttgacctatggtgccagccttcagtttctcagaagacatatgggacccagataaatcagacattgaatgcgctgacgagagtcgctgaggacccaagagaaaaggcttttttggtttggatttcatctgtatttcaccacttgaaaattcactattggcatcgggcatgtatagactcccatcaaggcacactgaccctgaaaaatggctgagctaaaataaaagctggcctcgttggcctcataacgctgaaacgaaatactgagttctaaatctggtgatttatcttttgacagctacaaagtgcgacacatcaacattacattgccagatttaatttctcatcttccatttcattgataattgtaaggtttaaaatccataacaatttatatgaagttctagttggtcaatactgtgatccagtcctcatactgaaacaatgttaacttacttaaaatccaccacaaaatattcaattatttgacagatgtttaacagaaagaataagggatcattaatgattccatttaaaaaatatttcatcacgagtgctacttttacttcagattcatgcaaatatggtgcttaaaactggatcatatttcaatccaaaaaccaacgcccgaagtatacggataatttccaagaacagaaaaaccataaataagatataaactcccccaaattcaaaataaattacataacttactct

SEQ ID NO: 284268 - DNA, 479 bp, Homo sapiens
aggctagacaaggagggctctgcaaacatatggcgtggcctggggctgtcagacagtagtgtcgctgcaggacacggaggagactggcagcgaggcagcagggtcggcaggagcccataaaggttctgatgacgcattcctcaggcccaatccgtagagcaggaggaatctaactggtgtccgagaagatgtgtttgacctatggtgccagccttcagtttctcagaagacatatgggacccagataaatcagacattgaatgcgctgacgagagtcgctgaggacccaagagaaaaggcttttttggtttggatttcatctgtatttcaccacttgaaaattcactattggcatcgggcatgtatagactcccatcaaggcacactgaccctgaaaaatggctgagctaaaataaaccccgatgcggccggaagtttttatctgcggcccccaaataaacggggtggcgggggtgggg

SEQ ID NO: 284269 - DNA, 1034 bp, Homo sapiens
aggctagacaaggagggctctgcaaacatatggcgtggcctggggctgtcagacagtagtgtcgctgcaggacacggaggagactggcagcgaggcagcagggtcggcaggagcccataaaggttctgatgacgcattcctcaggcccaatccgtagagcaggaggaatctaactggtgtccgagaagatgtgtttgacctatggtgccagccttcagtttctcagaagacatatgggacccagataaatcagacattgaatgcgctgacgagagtcgctgaggacccaagagaaaaggcttttttggtttggatttcatctgtatttcaccacttgaaaattcactattggcatcgggcataaccaacccagacatcctctaaaggaggagatacagaagttctcttcccaggcccactcaaagggttctggctcagaccctttttccccattccttaagagagaaaaaagacatatattttcaaggtatagactcccatcaaggcacactgaccctgaaaaatggctgagctaaaataaaagctggcctcgttggcctcataacgctgaaacgaaatactgagttctaaatctggtgatttatcttttgacagctacaaagtgcgacacatcaacattacattgccagatttaatttctcatcttccatttcattgataattgtaaggtttaaaatccataacaatttatatgaagttctagttggtcaatactgtgatccagtcctcatactgaaacaatgttaacttacttaaaatccaccacaaaatattcaattatttgacagatgtttaacagaaagaataagggatcattaatgattccatttaaaaaatatttcatcacgagtgctacttttacttcagattcatgcaaatatggtgcttaaaactggatcatatttcaatccaaaaaccaacgcccgaagtatacggataatttccaagaacagaaaaaccataaataagatataaactcccccaaattcaaaataaattacataacttactct

SEQ ID NO: 284270 - DNA, 261 bp, Homo sapiens
aaatctgatctggttgaggttacgttttcccggaatgcactatggtgaaagggatggctacttaaaagaacagtaaacttctatattatgcttatctaattagtgaattagaaataagaatgttcaagatcaaggtatatgtctgaatcattctgaatacaacggtcaggtgtcttttctcctgcttttgcaacaaggcagatggaaaataaaacacactaaaatgtttgaaagtgattactgcatacctggtgttcttta

SEQ ID NO: 284271 - DNA, 635 bp, Homo sapiens
tggtctggtgctgtataaatatattttctttttaattttgttttaacttcttccttgccctccttcacccaaatcccagccctccctgccctcccacactccccaaccccacctgccctgccccacctcttccttcccccacccacactctcttgtcctctctctctctctctctacatatataaatatatatataaatcttttcttcttttgtcattcaatcaaattccaacaacccaaccagggccagtcaaatccaccacagtctcgcgctgagctaggaataaagttcacgtaatcacatgagagtggagaaaagtcccccatccgtaagttcaaatcaactcaaagttcacagtgtgacatgatggcgtcatgtaacaaggctaagaatcggttgcatgacaattgccgtcaagtttcgtggaggtgctgtgattggagcgtttttcttggatgttgtatcagttgatgattggccagtcatgatcacacgtgcattttcttgacttttgtgctgccacaatcttttttgctgtgctcattttcgtttcgttcttggtgcttgcagtggttttactttctgttgtttggtttttcttgttcagcgtttttttcctcgtgccgagatgtca

SEQ ID NO: 284272 - DNA, 3343 bp, Homo sapiens
  misc_feature (19)..(19): n is a, c, g, or t
  misc_feature (21)..(21): n is a, c, g, or t
  misc_feature (23)..(24): n is a, c, g, or t
  misc_feature (26)..(26): n is a, c, g, or t
tacggtaggtagcgagcgngngnngnggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284273 - DNA, 3285 bp, Homo sapiens
  misc_feature (19)..(19): n is a, c, g, or t
  misc_feature (21)..(21): n is a, c, g, or t
  misc_feature (23)..(24): n is a, c, g, or t
  misc_feature (26)..(26): n is a, c, g, or t
tacggtaggtagcgagcgngngnngnggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaattttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284274 - DNA, 2718 bp, Homo sapiens
  misc_feature (19)..(19): n is a, c, g, or t
  misc_feature (21)..(21): n is a, c, g, or t
  misc_feature (23)..(24): n is a, c, g, or t
  misc_feature (26)..(26): n is a, c, g, or t
tacggtaggtagcgagcgngngnngnggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagca

SEQ ID NO: 284275 - DNA, 3315 bp, Homo sapiens
  misc_feature (19)..(19): n is a, c, g, or t
  misc_feature (21)..(21): n is a, c, g, or t
  misc_feature (23)..(24): n is a, c, g, or t
  misc_feature (26)..(26): n is a, c, g, or t
tacggtaggtagcgagcgngngnngnggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284276 - DNA, 3231 bp, Homo sapiens
  misc_feature (19)..(19): n is a, c, g, or t
  misc_feature (21)..(21): n is a, c, g, or t
  misc_feature (23)..(24): n is a, c, g, or t
  misc_feature (26)..(26): n is a, c, g, or t
tacggtaggtagcgagcgngngnngnggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaaggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284277 - DNA, 2225 bp, Homo sapiens
  misc_feature (19)..(19): n is a, c, g, or t
  misc_feature (21)..(21): n is a, c, g, or t
  misc_feature (23)..(24): n is a, c, g, or t
  misc_feature (26)..(26): n is a, c, g, or t
tacggtaggtagcgagcgngngnngnggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagagctccaggctcaggtggaaaacaatcagtgcatcagtctcctgaaccgtgggcaaaaggagaggcttcgcgagcaggaggagaggcttcaggagcagcaggagaggcttcgggaacaggagaagaggcttcagcagctggccgagccacagagtgacttggaggagctgaagccgagaacaagagcgcactgcagttggagtcg

SEQ ID NO: 284278 - DNA, 3316 bp, Homo sapiens
  misc_feature (19)..(19): n is a, c, g, or t
  misc_feature (21)..(21): n is a, c, g, or t
  misc_feature (23)..(24): n is a, c, g, or t
  misc_feature (26)..(26): n is a, c, g, or t
tacggtaggtagcgagcgngngnngnggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaaggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggccagtcaaatccaccacagtctcgcgctgagctaggaataaagttcacgtaatcacatgagagtggagaaaagtcccccatccggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284279 - DNA, 3147 bp, Homo sapiens
  misc_feature (19)..(19): n is a, c, g, or t
  misc_feature (21)..(21): n is a, c, g, or t
  misc_feature (23)..(24): n is a, c, g, or t
  misc_feature (26)..(26): n is a, c, g, or t
tacggtaggtagcgagcgngngnngnggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtcgcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284280 - DNA, 3375 bp, Homo sapiens
  misc_feature (19)..(19): n is a, c, g, or t
  misc_feature (21)..(21): n is a, c, g, or t
  misc_feature (23)..(24): n is a, c, g, or t
  misc_feature (26)..(26): n is a, c, g, or t
tacggtaggtagcgagcgngngnngnggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggtaatgtcatctcctcgaaagtgtttgtggatcgggcgactaaccaaagtaaatgctttggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284281 - DNA, 2968 bp, Homo sapiens
ggggggaagatgcagggtggggagactccgcggagggagcaaaatagaaaagcaaagggaggtacgagaggcagacagccgggaacaccgagaggcagagaagctccgagaacagtgcacgggagagaaagagaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284282 - DNA, 2879 bp, Homo sapiens
actcctaccggccagaaagacagcccatggtcaagtgtggctagaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284283 - DNA, 1971 bp, Homo sapiens
tggtctggtgctgtataaatatattttctttttaattttgttttaacttcttccttgccctccttcacccaaatcccagccctccctgccctcccacactccccaaccccacctgccctgccccacctcttccttcccccacccacactctcttgtcctctctctctctctctctacatatataaatatatatataaatcttttcttcttttgtcattcaatcaaattccaacaacccaaccagggccagtcaaatccaccacagtctcgcgctgagctaggaataaagttcacgtaatcacatgagagtggagaaaagtcccccatccggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttat

SEQ ID NO: 284284 - DNA, 535 bp, Homo sapiens
gcggccgcacctatgaccccaacctcaggtgagctggcaggtgccaacacgcggtctggcccggtgggagaacagctggccccaggctgggacctaatttcagctaccagcggaccattctgtggcaaaagcacatagtgtctgggcccgagaggacttgccttctggcagtttgtctcaaaaatgttctaatccatggggatccaagggaagatgagatatgggacccatgcagtctaccgtgtgatttcagggtggggtggatttctctcaagctgtttaaccttatcaggaaacaatgtatcttgatgtttaccaacaagagacctggaaagaaattgacatgaagacatctccctgtggtgtctatgatgagaagagccttggccattctgtggccttgttcagcccctggcccaagcacagaaggaacccatttgggtgtcgtcttttttttttttttttttttttcatttccctttaacccaatctagactcactggctttttctaagacaactatgcaacaagctaga

SEQ ID NO: 284285 - DNA, 5857 bp, Homo sapiens
cataatcaacctgaaagaagaaaataaatactgtatacttttaaattttatcgattcttaaaaactggacactcaaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggacgcatggggataaatttccatcatccaggaacagataatattatggcacttaacagtcgatcttctctctttccctttgaagatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtacggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagattttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaatagatggtggaaactactttcccttaatttgtatatttctaatcaagtgttgattgtgcgcgactgaccaggattgtgaaagagttcttctgtttgtatttttttaaagagaacttttttagtttattaaattataacatgttcccttttgttttgtaaataaatgtgcccccaagttgttaatgttatattaaaagagagggtccttcaaaaaaattattttttaaaacacagaggtgttctgacctgcaacttgactgggaagcccctgggtaacacaggtcctgctgtggcctttccttggtgtgacacttgaactagtcgattttttgaaggctataacctaacctcgactatttgttgttatgtgcaatactgtttgtactgtttgtataaaaaatagaaaaaaaaaagaaaagaaaaaaggcataaatctttattgcagatttattttcattgcaaactttagacattgtgattcactgaaatcatttttctactgtcaaatatgtaccttttcttcatgctggtattttttcaatagtaatgtagcctttgtactgagacaaattttcattgttatttttagaaagattttttgctaagaaaaaaattaaacatatttacatatttttcattttatttcgtattttctttaaggagtgctttctcaatcattaatagagttgtttctgggagggactttcatatctggtcaatgtcataatattattttgtatttttattggaataaattaattttatgatgctaattctttaaaagtttatttttttcattttcagttatttttgaagctaaaacctttgtaatattgttactaaagtgtctagttttttgaaatgcaaagctttatgtattaacttgctgatgtggtttacaatagtgtgacaacgatgaaaatgcttggttatgtaaagtgattggaaatgtaatggataattgggtaataaaatgacagatgagcagaacatgtgagattttgagaagccttttcctttatcacagtggtttagtgtaagactagggatgtcacagtgcagttctctagggatgtcacggtggatttatacaacaccaggtgcagccaaacctgtggccctgagaatgaa

SEQ ID NO: 284286 - DNA, 432 bp, Homo sapiens
atgtagtcttcggaccggtctccactagaggctgcacagcccgcccggaccaacgcctccgcgcctgccgccgtctggccggcgccctcccgtttccttcctccagggggaaaaaatgtctttcgggccgctttccaggaagcagcaggatgcgccgctccactgtcggtagcaacaagcttgcttgtaagaggaagagaaaaagaccactcaggaatagaagggaacttcctcaacttgataaagtgcatctacaaaaaaatctgtagccaacatcttgcctgatggtgaaagactgaatgctttccccctatgatcaggaacaaggcaagaatatgtcctcttacatcctctattcaacgttgtactggaggttctagccaggtcaattagtcaagaaaaagaaataaaaggcagccatattggaaagga

SEQ ID NO: 284287 - DNA, 5904 bp, Homo sapiens
atgtagtcttcggaccggtctccactagaggctgcacagcccgcccggaccaacgcctccgcgcctgccgccgtctggccggcgccctcccgtttccttcctccagggggaaaaaatgtctttcgggccgctttccaggaagcagcaggatgcgccgctccactgtcggtagcaacaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggacgcatggggataaatttccatcatccaggaacagataatattatggcacttaacagtcgatcttctctctttccctttgaagatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtacggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagattttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaatagatggtggaaactactttcccttaatttgtatatttctaatcaagtgttgattgtgcgcgactgaccaggattgtgaaagagttcttctgtttgtatttttttaaagagaacttttttagtttattaaattataacatgttcccttttgttttgtaaataaatgtgcccccaagttgttaatgttatattaaaagagagggtccttcaaaaaaattattttttaaaacacagaggtgttctgacctgcaacttgactgggaagcccctgggtaacacaggtcctgctgtggcctttccttggtgtgacacttgaactagtcgattttttgaaggctataacctaacctcgactatttgttgttatgtgcaatactgtttgtactgtttgtataaaaaatagaaaaaaaaaagaaaagaaaaaaggcataaatctttattgcagatttattttcattgcaaactttagacattgtgattcactgaaatcatttttctactgtcaaatatgtaccttttcttcatgctggtattttttcaatagtaatgtagcctttgtactgagacaaattttcattgttatttttagaaagattttttgctaagaaaaaaattaaacatatttacatatttttcattttatttcgtattttctttaaggagtgctttctcaatcattaatagagttgtttctgggagggactttcatatctggtcaatgtcataatattattttgtatttttattggaataaattaattttatgatgctaattctttaaaagtttatttttttcattttcagttatttttgaagctaaaacctttgtaatattgttactaaagtgtctagttttttgaaatgcaaagctttatgtattaacttgctgatgtggtttacaatagtgtgacaacgatgaaaatgcttggttatgtaaagtgattggaaatgtaatggataattgggtaataaaatgacagatgagcagaacatgtgagattttgagaagccttttcctttatcacagtggtttagtgtaagactagggatgtcacagtgcagttctctagggatgtcacggtggatttatacaacaccaggtgcagccaaacctgtggccctgagaatgaa

SEQ ID NO: 284288 - DNA, 396 bp, Homo sapiens
aacttgcactcgttggagaactccttaatggatatgataaggactgatcatgaacctctgaaaggtaaacactaccctcccagtggcccaccaatgagtttcgctgatataatgtggaggaatcattttgcaggttaggaatattcatatgtccatttcttgcttggtgttttaagcaaaaatcagctttttaataattttgatttttctggtttgttttttgtttgcttgtttttgttttgcttctgtaaagcattgtggaatgtatttaaagttgattttttttaacctgggttcagctacctataataatcaaggtggattgttatcagtcatgtctggcaggagcatgaattgggtagctgaggttagtcacattatgagttaatagcgtga

SEQ ID NO: 284289 - DNA, 498 bp, Homo sapiens
gaaaaacacagactgcagccattgtgagttacccagaactcaaacaaataggaatataatttactgaaaaataagaaaaatcaagcaacattttgggaacgtgtcagaaagcaagtattaaacattttgggccctgaagcaaaagccagggtgttcactgatctgttatttccaattgcagcttgcttgtaagaggaagagaaaaagaccactcaggaatagaagggaacttcctcaacttgataaagtgcatctacaaaaaaatctgtagccaacatcttgcctgatggtgaaagactgaatgctttccccctatgatcaggaacaaggcaagaatatgtcctcttacatcctctattcaacgttgtactggaggttctagccaggtcaattagtcaagaaaaagaaataaaaggcagccatattggaaaggaagaaataaaactatctctatttgtagatgaaatgatcttgtatttagaaaattccaagaataaa

SEQ ID NO: 284290 - DNA, 701 bp, Homo sapiens
ttttgaggttaatgtgctaagaggatatgagattgaagctgctggcacccagctctccctgccacagggcagagaatggggccaaggcataaagagaagcagagctctgagaaatggaatgagagagacctgatgacattgtttgagcccctgagatgagccttgcctgaggggttccccagccctggatctggcctgctccgccttgcgaaggccccacagcttgcttacctcagcaattcacagcggaagtgtgacaaacgttcataggcaaatgtcaggtcagatgtcaacttgttgctccacagcctttcggcaacagcccctgctctgggcctggaggaaaaggggcatgtgccagattgggccctgtattccctgcaaaggtgctggacatccacaggctgctacctcttgtctaggcaccctggactcactcaggccaaaggaagtgatcaataccttgttatgagccacagccaggttggatggctcccagagagttctacggctcagctccaccttcattaaaatgtgggtagcaatcccactctcttcctctctcaaagatatgggaataagaataaaccttaaagccatcattaaccacaatgacagtggcagcagcagaggtccttaaaatgtaaactttgcacacccaaccatacttggtaaggctgcagtgaaaacagcagagggaa

SEQ ID NO: 284291 - DNA, 2145 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaa

SEQ ID NO: 284292 - DNA, 2307 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacagtacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaa

SEQ ID NO: 284293 - DNA, 772 bp, Homo sapiens
ctttggggttctggtccacatattggaccctgttctattttgtgacttttattttttattttttgagatggagtctcactctgtcatccaggctggagtgcagtggcacgatcttggctcactgcaacctccgcctcccaggttcaagtcattctcctgcctcagcctcctgagtagctgaaactacaggcacatgccaccatgcccagctaatgtttgtatttttagtagatatggggtttcaccatgttggccaggatggtctcgatatcctgacctcatgatccacccgtctcagcctcccaaagtgttgggattacaggcgtgagccaccactgcacctagccttgtgacttttattctatgtcctgtgtctgggtcctatgtcctgaattttccctcaaattctgagtcacactttatgttacgttaatatgtcctgggctctaccctgctctggttttatatttctggtgctatattctgggtcttgcccctcatcctgtgcttatcaagttgtctaggcctcaccagtgtccctactgtaggaaatgtggtcctcttaacagctctgctctgtttcagtaactctctgtcctggtatggtggggaatcctacatccagagcatggagccaggggctaaggtagtgacttgggcctgagggcattgggaggtcccaagggaaagacaagggtgggattggactgaacagaggtgatcaagggtgaagacagggagtatgtattgtggcacctgccaccctactcca

SEQ ID NO: 284294 - DNA, 428 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatggtgtgcacggaggggcccgg

SEQ ID NO: 284295 - DNA, 2173 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtctaccccagccccatctctgcccctgctacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaa

SEQ ID NO: 284296 - DNA, 2540 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccggtgaggatgcctacatcccccaagcaagagctacttctccctcccggctgcaggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcctgactttccagcctcctgcaggctcctgcctctaaccagcctctaccccagccccatctctgcccctgctacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaa

SEQ ID NO: 284297 - DNA, 2367 bp, Homo sapiens
cgagggaatccgaaaggctactctggggctcaaagacggtgggggatacctctctgtgtagggaccagggggcgaatgaacccggtctttacatgtgatgtcttcaagattgaggagcctggatcttcagcctaagaactgacccattttggggatggagaggggattatgacagcatgttattctgaactcacaaatcatatgctccctcctctctaatccggtgttcctgtagatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccggtgaggatgcctacatcccccaagcaagagctacttctccctcccggctgcaggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcctgactttccagcctcctgcaggctcctgcctctaaccagcctctaccccagccccatctctgcccctgctacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaa

SEQ ID NO: 284298 - DNA, 2035 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcctgactttccagcctcctgcaggctcctgcctctaaccagcctctaccccagccccatctctgcccctgctacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaa

SEQ ID NO: 284299 - DNA, 2007 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaa

SEQ ID NO: 284300 - DNA, 1783 bp, Homo sapiens
tcagatacttccacgtgaccccctcccgtcgagtctcaggctgcgtatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaa

SEQ ID NO: 284301 - DNA, 1615 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctgtccatccctgctatatccctagcctgactttccagcctcctgcaggctcctgcctctaaccagcctctaccccagccccatctctgcccctgctacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcagtgactaggcctggtgtgggcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctcaaaaaaaaaaa

SEQ ID NO: 284302 - DNA, 2140 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccggtgaggatgcctacatcccccaagcaagagctacttctccctcccggctgcaggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcctgactttccagcctcctgcaggctcctgcctctaaccagcctctaccccagccccatctctgcccctgctacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctcccctgccctctccctgaaataaagaacagcttgacaga

SEQ ID NO: 284303 - DNA, 1613 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccggtgaggatgcctacatcccccaagcaagagctacttctccctcccggctgcaggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcctgactttccagcctcctgcaggctcctgcctctaaccagcctctaccccagccccatctctgcccctgctacgggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccacacacggatgtgcaccagaggctggcagtggatcagactgtggtccaggggattca

SEQ ID NO: 284304 - DNA, 1378 bp, Homo sapiens
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccggtgaggatgcctacatcccccaagcaagagctacttctccctcccggctgcaggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcctgactttccagcctcctgcaggctcctgcctctaaccagccttctagtcagataacgcaggaacaca

SEQ ID NO: 284305 - DNA, 193 bp, Homo sapiens
tgctcaagtgccatgtgtttcgctgtgatgtccctgccaaggccattgccagtgccctacatgggctttgtgcccaggtaagtgtcaggggtggggcagggaatgtgggtaaggggttgggtctgaagcttccaaggtagttggggtggtattggcccttttaccctaattcccctctctccctgtgggtcat

SEQ ID NO: 284306 - DNA, 4160 bp, Homo sapiens
tcaatactgttagttgagatgtggaccatctatcagtttgtaattaagaaaaagtctggcacgtgactgaaactgaggaagaagtagaaaaggcaaaaggtcaaaggtctcatgggaaggaaggagggtagagacagtgagttttattggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcactctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaagattgtttttaatttttaaaatcctatcagcagcctcctaattagcagtgttaggaatttgccttatgttttccatctcatctcctgaacctgttattctgagaactcataaataaaattcagccaagattaatcaatcaatc

SEQ ID NO: 284307 - DNA, 4223 bp, Homo sapiens
tcaatactgttagttgagatgtggaccatctatcagtttgtaattaagaaaaagtctggcacgtgactgaaactgaggaagaagtagaaaaggcaaaaggtcaaaggtctcatgggaaggaaggagggtagagacagtgagttttattggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcactctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaagattgtttttaatttttaaaatcctatcagcagcctcctaattagcagtgttaggaatttgccttatgttttccatctcatctcctgaacctgttattctgagaactcataaataaaattcagccaagattaatcaatcaatc

SEQ ID NO: 284308 - DNA, 3221 bp, Homo sapiens
tggtggagtattggtggaaacccattgagactgggttgtggagagaatatgatgtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcactctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaagattgtttttaatttttaaaatcctatcagcagcctcctaattagcagtgttaggaatttgccttatgttttccatctcatctcctgaacctgttattctgagaactcataaataaaattcagccaagattaatcaatcaatc

SEQ ID NO: 284309 - DNA, 2904 bp, Homo sapiens
ctcaggttataatgctcactgccctgccgctcacctcctgctgtgtggcccagttcctaacagccaccgactcttactggtcagcagcccaggggcgttgggaactcctgattaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcactctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaagattgtttttaatttttaaaatcctatcagcagcctcctaattagcagtgttaggaatttgccttatgttttccatctcatctcctgaacctgttattctgagaactcataaataaaattcagccaagattaatcaatcaatc

SEQ ID NO: 284310 - DNA, 4252 bp, Homo sapiens
tcaatactgttagttgagatgtggaccatctatcagtttgtaattaagaaaaagtctggcacgtgactgaaactgaggaagaagtagaaaaggcaaaaggtcaaaggtctcatgggaaggaaggagggtagagacagtgagttttattggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcactctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggatctgcagtacagtgttgaatagaactggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaagattgtttttaatttttaaaatcctatcagcagcctcctaattagcagtgttaggaatttgccttatgttttccatctcatctcctgaacctgttattctgagaactcataaataaaattcagccaagattaatcaatcaatc

SEQ ID NO: 284311 - DNA, 3853 bp, Homo sapiens
tcaatactgttagttgagatgtggaccatctatcagtttgtaattaagaaaaagtctggcacgtgactgaaactgaggaagaagtagaaaaggcaaaaggtcaaaggtctcatgggaaggaaggagggtagagacagtgagttttattggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgaatcttgctgcatcacccaggcaggagtacagtggtgctatcacagctcactgcagcctcaacctcctggactcaggcaatcctccttcctcagcctcccaggtagctgggaccacaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaagattgtttttaatttttaaaatcctatcagcagcctcctaattagcagtgttaggaatttgccttatgttttccatctcatctcctgaacctgttattctgagaactcataaataaaattcagccaagattaatcaatcaatc

SEQ ID NO: 284312 - DNA, 3402 bp, Homo sapiens
tcaatactgttagttgagatgtggaccatctatcagtttgtaattaagaaaaagtctggcacgtgactgaaactgaggaagaagtagaaaaggcaaaaggtcaaaggtctcatgggaaggaaggagggtagagacagtgagttttattggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcactctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggtaaagccaggtgctctgggggcacccatctggtctggaagcccaaggagggtggggatgcaagagaggatgaaggagcagtgcctgggggcatggacatgtgactgcaccttccagtggcgggccacctcactgcctaggcacgggtgctggagcaaccagcagttggaaatgttggccacaacatcttttgctttctttcattccaaaccttcatatccctgatgtgcaatcctgtgtcccatgcaaccctaaggaccatgc

SEQ ID NO: 284313 - DNA, 1293 bp, Homo sapiens
tcaatactgttagttgagatgtggaccatctatcagtttgtaattaagaaaaagtctggcacgtgactgaaactgaggaagaagtagaaaaggcaaaaggtcaaaggtctcatgggaaggaaggagggtagagacagtgagttttattggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggtagtttcttacttttatttctttatactttattattcattttgttttcataagtggacaaaatttaagagtatgagtttggaagaagtaagagaatgggaacagaaggtaag

SEQ ID NO: 284314 - DNA, 251 bp, Homo sapiens
agctacagtccgggaacttctgcaggacggtaaggagacggggtctgaccaggtcgtggggttgggggtctgcgctgctccgcacctggacagcgaggtggacccaacccgttgctttgcagaaagttttccagtctggacgtgaccactcccctccgcccggccccctggcttgggtactgttctagccaacctatttactctgggactggctccctcttttctggagtcttggggacacttggtttctg

SEQ ID NO: 284315 - DNA, 428 bp, Homo sapiens
gtgtactcttgaaaataatgtgctttctctcattgttaggagtagtgttctataaatgtcaaacaggtcaagttaatgatagtattgtacaatcttctctagccttaccgataatgtttttactgttctattaactttttttttttttccctgagccagaatcttgctgcatcacccaggcaggagtacagtggtgctatcacagctcactgcagcctcaacctcctggactcaggcaatcctccttcctcagcctcccaggtagctgggaccacaggtgtgtaccacagtacctggctttttttatttttcccagtagatatggggtctccttaggttgcccaggctggtcttaaactgctggtctcaaggatcctcctgccctggcctctcaaagtgctggaattacagtcgtgagccaccacacc

SEQ ID NO: 284316 - DNA, 404 bp, Homo sapiens
tccattgatattctgaaaatgattttattctcactcctctcttttcctgtaggataaaagcaaaaattgttgaaccatacaataagatagttgcccggactgcacaactagcaagacttcaggtagtttcttacttttatttctttatactttattattcattttgttttcataagtggacaaaatttaagagtatgagtttggaagaagtaagagaatgggaacagaaggtaagagaaaaggagaaaaaaatactaaaaagccttaagatgtctagctcaaaaaatacaaatctaaagcaaattcttttcactgtcattgcagtgtataattgtttattaacttatatcttcttcaatttctttcatcaatgttttatagctttcaatgtatagatgcttcac

SEQ ID NO: 284317 - DNA, 762 bp, Homo sapiens
agcccctcatcccatggaggaccctcccttcactccactcacttagaggctgttctcacgttgatatccaagtcacccttgaacacaaactgaccaggtttccaatgaaaagacaggtggctccactcccagtgcatattttcagttgtgttgtatggatcctatgaccacccccgagaatttggtgagatatagaagggtctcagctcacctcccatttcacccatcacaaacgtccctcagccaaaccaactgcctcatctctactcacagtgaaagtcatggtagaatttgagtgggggcatgttcctctccactgccacgttaccccacggaagccccaagtgcaagatctgacgccgacgggagcaaggctgaccactctgctcggtgcccacaagtcgacccattagccgccagtcacggatctcaaacagcctcatctagagttcgagaaaagtcatactgataaggaaactccaccgagactgagccgaaagagaggagccaaacacggttccggagggtctgcagcgcagggaaggggttccggtggaggatcatctcttccagctcaggtagcagctgcacctccacctccttgaagttgaagatactattgccatcaaagccagcagccagctctggacagtatgcctgcagggaacctccatgccggctcagtgacacactctctgcagccagggtaatgaacttgtcctcagctacaaaagctgtgagcttggctgtgctcacctccag

SEQ ID NO: 284318 - DNA, 453 bp, Homo sapiens
cagcacactggagtttttgtccagaagtttgactttagaagataagaaataactgagcgtattacaagcaggagttagaggaagagactcagtacagaagagacaggaacaaaagttcacctccattcaatgggaaaggatacagatcaagagttcaggaaaagtaggagaaagaagctctattccagaagcagtctggagcacaaagaatccctaatcactgacattaagaaagaagaaaaatattcctaggacgatcctggagagcaaaggtcatcagcagtcacttgactttccttggatttctcaactgcagtagtcacatggtctgctgaaaatgaattctctttattttcatctgatttcaaggaattatggttttcagtgatttcttcatttggatctattttgagacagagtaatagcattaaaacccccttctgaattaataag

SEQ ID NO: 284319 - DNA, 2336 bp, Homo sapiens
tgcttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttccttcccctgcttgctatacattgtctggaactggctaagaaatggggaacatttgtgaaaaccaagaaatgtaatggttttggatgaataaaatagaccaaagttaaggtaagtgcacaaatatcagtgtcaggctatggaagaaagataaagagatacttttttttttttttttttagaggggagatgctgaggtcagggcacttatgtgcatcaagtgatggagacagagtaaagagaatttatggatatatatgcatatcttgctaataagtttggtttatcatcacatcaagataaattgcctttagcatagaacttgagataagtagacgttcactagcaagtgctaacatttgg

SEQ ID NO: 284320 - DNA, 2042 bp, Homo sapiens
ttgtgaaaaacaattatgggaaattatttttgcttttccaaaattatgacaacaaagaaaacccaaatttcatccccagcccccctaaaaacataaatgatttcgatcacttttttttttttgaggaagagatgcatcagcttttaaataaatggtgaagagcaataacatctgatggagaggggccacctgggctcatttcacctgtgcagtggattcaggtggtgggccatatccatcccatactgcagtttgtggttgctgttgttaggggtgccatatgtctttcccttgttctttgtccactgatattcactagcctgtttgtcctcacccctgaagcagataaacacatgtagatggaggaaaagtgacaggcaggtgggttcatcagtgggctcatcccaaaggtgacccatcccttggattggagtcaggtctattttaggcatggcaggttggaagaaagactattctcatagctaacatggctgaccttcaaccctcttttccctttagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttccttcccctgcttgctatacattgtctggaactggctaagaaatggggaacatttgtgaaaaccaagaaatgtaatggttttggatgaataaaatagaccaaagttaaggtaagtgcacaaatatcagtgtcaggctatggaagaaagataaagagatacttttttttttttttttttagaggggagatgctgaggtcagggcacttatgtgcatcaagtgatggagacagagtaaagagaatttatggatatatatgcatatcttgctaataagtttggtttatcatcacatcaagataaattgcctttagcatagaacttgagataagtagacgttcactagcaagtgctaacatttgg

SEQ ID NO: 284321 - DNA, 1994 bp, Homo sapiens
tgcttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttccttcccctgcttgctatacattgtctggaactggctaagaaatggggaacatttgtgaaaaccaagaaatgtaatggttttggatgaataaaatagaccaaagttaaggtaagtgcacaaatatcagtgtcaggctatggaagaaagataaagagatacttttttttttttttttttagaggggagatgctgaggtcagggcacttatgtgcatcaagtgatggagacagagtaaagagaatttatggatatatatgcatatcttgctaataagtttggtttatcatcacatcaagataaattgcctttagcatagaacttgagataagtagacgttcactagcaagtgctaacatttgg

SEQ ID NO: 284322 - DNA, 2072 bp, Homo sapiens
gcgagctgtattcaatatgcttatgttttatttatgtaggtggcatttaaaatacatgatgtgtttagggttacattgtccacagaaagcatcaaataccactcctctccccgccaaaaccaaataaacaaagccaactctttggcaacagttgtgttaaataaaatcccaggtcacacttgtttctggctcccaagcctgggtcactgctacatggattgcgccaaaaaattcccagcttcaacactgctagattaaaattgctggcatttttaaatcacagcaaagcttttcacaatgccctcaagtccaagaggacaaaggagaaagcaacatgaacggcagatcctcatgtgaaagggaaggaaagtcactgggagggagcatgcagggaagaagtcaaggcagccctggaattctactccgtgctcaataaaaaaaaaacgtgaagaagcaatacatcatgcaaacgaaataatgaccggaagtgggcgcatctagttagaatgaagtgactttcgtaaggagtcaatgttcgcgaactgaaacatgagttcaacctccttgtgccgtctctgggtgttttgcacgtgtgtaaataccggcccgttttccccagcatggccctaacccatggacactagggagggtgccactgagcaaaaattttttgctaaaaataattagcaaaaatccaagaaaaaaatatggaatctagcaaaacctacaccatatttgaagttgaatttgcactacctgcaaagcaaataatttaaaagaataaacattgtgaacatcaattcccatcacagcaagccctggatgaaaacatggacctcttggaaggtataactggctttgaagactctgtccgaaagtgtaagtccctctctgaggctgggctccccaaggggaaggggtagggagtggcagccaggtccggggggacagctgctcaccggttttgtctctgacctccacagttatctgccatgttgtgggtatcacttaccagcacattgaccgctggctgctggccgagatgctcggggatctgtcgggtaacgccctctgggtcctggtgcacatctgggaggttgggggtggctagggcagtggacctcagtcagctcctccaacaggcctgtctgggtctcatcaggtcagcatggaaggcccagcccaaggaggaaataagaacttggtataagacagtctctgccttgagggagatcctatgccatttgctcatttattttgcattaattgagtgcctaccgtgtgtcagtgtgctaaactgggcgtgcagcagtaaacaaagtgggatggctccaattcattctcatggaggtagcaaagcacatggcgacatggaggtgtccagtggtgattcctgtcatgaaggaaagcaagacagctcacagaccagcggcatctgagcccttacctccgtagagagaggcccgtggcctgaggtagtgcagaggaggatagtagagcagggccctgacttgtaacgttcatgggtagccagggtgtatgtggccagagcagagtaagcatgggcgaaagtagagagctgggggttggaggggcatttccaggtcatgtggggcctcgggaggaccttgtcctttcccctgactgagaaggagccaccggagggctctgagcagggtagggctctgatcagatggatattttttaaagatccccccaagaacaaaaaaagaaaaaataacttatttgcttacttttgtaaaaagaaacgtagaaaaggaagtcaagaaactaaggaaggccgggtgcggtggctcccgcctgtaatccagcactttgggaggccgaggtgggcggatcatctgtggtcaggagttcgagaccagcctgcccaacgtggtaaaaccccctctctactaaaaatacaaaaaattgctgggtgtggtggcgtgcacctgtagtcccggctacttgggaggctgaggcaggagaattgcttcaacgcaggaggcggaggttgcagtgagctgagatcgcaccattgcactagtgataagatcgaaactccatct

SEQ ID NO: 284323 - DNA, 2107 bp, Homo sapiens
gtagacctcttggctttcacttccttcctagtgctatgagcaactgccatggtccaggagccagctggccttgcaccttgactccctggcactggtcacaaagcgtagcagttggtcaggggcagaatggtttgtcttggtaaatcacagcagggggtggaccctgctagggtccacatccgaacctgggcctctcagcctgctgattccaggctgggcgtggcagtgtatgtctggatcaggcagtgagctgtcaggcccctagcctgccccctgcccagccacaggcctcagtgcaggctttgtcttcaaagacagagctgtgagtgcccaaggagctttgactgctcatcaggtgtgtgtgctgagatgggtttgagcccaggtcagggctcctgccagggcctgtcatcccttcacagtgagcctgtgccttagcccttgcacagccaccaatgaatgctttgcccgatgtccccagatgccaccctgggtccaggctggccttgggagccagctctagagcctgctacccaagtccacccaccctgctgacatgcctgcctctggagcccccactcccagccgacacgtctcacttcccacccttgcaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccata

SEQ ID NO: 284324 - DNA, 983 bp, Homo sapiens
  misc_feature (835)..(835): n is a, c, g, or t
cggacgcgtgggtcgacccacgcgtccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccataanaaaaaaaagggggggggctaaaatatcccgaggggccagttacgtacccgttttgtcaaagggccaaggaggataaacagcacggcgggtaacggggggaagcgtggttggaggccccgggggatggcccaaaagcggaaaaaggggg

SEQ ID NO: 284325 - DNA, 668 bp, Homo sapiens
ccattccctctccgttttcagccctcaggtgtgattgtgatcttgcattattctaaaaagcagccagagccctgggacctgcagccacagagccaacagctccctagcaaaggaaaacagacaagatggaacacggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttctcgggtcctcaaccaggcccaggggccacccccaacccacggactgtccacagatcacacgagcagaccgccgcacggacaagggagacccgcgccccggcgatccccaccacggccccg

SEQ ID NO: 284326 - DNA, 591 bp, Homo sapiens
cgactcttagaggatccccactgcggttgcctcgactgtgcgctcagctcttggagcgggctgggtgtttggggccagcggcggcagcggcaggcacggcggcagcagcggcagggtggggcgaacaggtagagcagcacgagcacaaggcccacggcacagcccagcagtgtggtgaagcctgtgttgaaagcctcgggctctgggcgcggaaagtgcacgctcacgttgtactcgtgcgtctggttgtggtgcaggcggggcccagtggccaggcacacgaagagtcccgcatgctgctcctgtacgttgcctatggccaagctgccgtcggccagcaccgcgatgctgccatcgcgggatcctggcgccctgagaagctcctgctgcggcgaaacccaggcaatgcgcatggccgggacgctggtgttgcagtaaagcctcagggaccgacccaccagcgcgtacaggtgctcttccggccgctctaggccaagagctggggccgacgagcagttctcaaagacgcggctgtgctggaagaagcgcacgcgggacgcgggtaccttgaaggccaagcatacgtactcg

SEQ ID NO: 284327 - DNA, 440 bp, Homo sapiens
ggctggaggctcagcgcgcaagcgtgcgcgtgatttggccctgaacggacgccgtagccaagaggttgggcggatgttgtgagccgggtcgctgcggccgaggctccggcccccaggaccactggctgcccatgagagatgaaggatggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggaaacccctgaacttccagaacctgccagaacatttggaccagttgctacaggtggacaatgaggaggaggaaagccaggcttgactttcagtcagggccacagtgagcattaaattattattccata

SEQ ID NO: 284328 - DNA, 3041 bp, Homo sapiens
agttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaaggtcagcccgccttgggcacggggtagggtgggaggtgtgtgtgtgcacatgagggtgcttggaggtgcccatgtctaggtgggacttggggaaccctggtggtggagccctggcccaaacctgccccccatctcctggagcctgagggccatgttcctcacctgacctccagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccaaccaccacatccaacctccttgcctgcctgtatcctcattggtgggagcccagccatggccctaattgtgcctgagcttgactttcagtcagggccacagtgagcattaaattattattccata

SEQ ID NO: 284329 - DNA, 2688 bp, Homo sapiens
ccctagattgagaagtttcaatagcagtgagaacgcagtggcgggggaacatgcccatgctctgccccccaggcagggcaaagagagcacggagatgaaggaggagaccgcagaggagcggctgcggcggcgagcctacgaacggggctgtcagcggctcaggaagcgcatcgaagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccaaccaccacatccaacctccttgcctgcctgtatcctcattggtgggagcccagccatggccctaattgtgcctgagcttgactttcagtcagggccacagtgagcattaaattattattccata

SEQ ID NO: 284330 - DNA, 3470 bp, Homo sapiens
agttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaaggtcagcccgccttgggcacggggtagggtgggaggtgtgtgtgtgcacatgagggtgcttggaggtgcccatgtctaggtgggacttggggaaccctggtggtggagccctggcccaaacctgccccccatctcctggagcctgagggccatgttcctcacctgacctccagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccatacagccctggccctggcccttcttgagggagtggggtttgtggggtgtgcccagcagggatcctgccagatgatgtccacatgagaaggcaggtgtccaacagcttcagcttcacccagtgccccccagacaaataatgacaagtccagggtcttctgatgtgtcaggccagcactccccttgctgatgggaaaaccggggctcggccagccccactgcatcccctcacatgatgatacgaggctctggcactgactcgccaatagactt

SEQ ID NO: 284331 - DNA, 3113 bp, Homo sapiens
agttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaaggtcagcccgccttgggcacggggtagggtgggaggtgtgtgtgtgcacatgagggtgcttggaggtgcccatgtctaggtgggacttggggaaccctggtggtggagccctggcccaaacctgccccccatctcctggagcctgagggccatgttcctcacctgacctccagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactggcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccata

SEQ ID NO: 284332 - DNA, 1628 bp, Homo sapiens
ccattccctctccgttttcagccctcaggtgtgattgtgatcttgcattattctaaaaagcagccagagccctgggacctgcagccacagagccaacagctccctagcaaaggaaaacagacaagatggaacacggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccata

SEQ ID NO: 284333 - DNA, 3351 bp, Homo sapiens
  misc_feature (3203)..(3203): n is a, c, g, or t
agttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaaggtcagcccgccttgggcacggggtagggtgggaggtgtgtgtgtgcacatgagggtgcttggaggtgcccatgtctaggtgggacttggggaaccctggtggtggagccctggcccaaacctgccccccatctcctggagcctgagggccatgttcctcacctgacctccagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccataanaaaaaaaagggggggggctaaaatatcccgaggggccagttacgtacccgttttgtcaaagggccaaggaggataaacagcacggcgggtaacggggggaagcgtggttggaggccccgggggatggcccaaaagcggaaaaaggggg

SEQ ID NO: 284334 - DNA, 1039 bp, Homo sapiens
tacgtgcttgtggacgctggccttgcggctgggtgcgtctggcggtgtggtgctgagtactgaggactgtgcgctcagctcttggagcgggctgggtgtttggggccagcggcggcagcggcaggcacggcggcagcagcggcagggtggggcgaacaggcggggcccagtggccaggcacacgaagagtcccgcatgctgctcctgtacgttgcctatggccaagctgccgtcggccagcaccgcgatgctgccatcgcgggatcctggcgccctgagaagctcctgctgcggcgaaacccaggcaatgcgcatggccgggacgctggtgttgcagtaaagcctcagggaccgacccaccagcgcgtacaggagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccata

SEQ ID NO: 284335 - DNA, 3090 bp, Homo sapiens
agttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaaggtcagcccgccttgggcacggggtagggtgggaggtgtgtgtgtgcacatgagggtgcttggaggtgcccatgtctaggtgggacttggggaaccctggtggtggagccctggcccaaacctgccccccatctcctggagcctgagggccatgttcctcacctgacctccagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaaccatggccctaattgtgcctgagcttgactttcagtcagggccacagtgagcattaaattattattccata

SEQ ID NO: 284336 - DNA, 3099 bp, Homo sapiens
agttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaaggtcagcccgccttgggcacggggtagggtgggaggtgtgtgtgtgcacatgagggtgcttggaggtgcccatgtctaggtgggacttggggaaccctggtggtggagccctggcccaaacctgccccccatctcctggagcctgagggccatgttcctcacctgacctccagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccata

SEQ ID NO: 284337 - DNA, 2982 bp, Homo sapiens
agttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaaggtcagcccgccttgggcacggggtagggtgggaggtgtgtgtgtgcacatgagggtgcttggaggtgcccatgtctaggtgggacttggggaaccctggtggtggagccctggcccaaacctgccccccatctcctggagcctgagggccatgttcctcacctgacctccagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaaccaccacatccaacctccttgcctgcctgtatcctcattggtgggagcccagccatggccctaattgtgcctgagcttgactttcagtcagggccacagtgagcattaaattattattccata

SEQ ID NO: 284338 - DNA, 2490 bp, Homo sapiens
agttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaaggtcagcccgccttgggcacggggtagggtgggaggtgtgtgtgtgcacatgagggtgcttggaggtgcccatgtctaggtgggacttggggaaccctggtggtggagccctggcccaaacctgccccccatctcctggagcctgagggccatgttcctcacctgacctccagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagtgagtggggcctggggggcacacaccctggccacaagcaccatgcccagcctcaccccgtctctcccctccttgccctcacaggcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacaggtgtggccatctgggcaacaagggtgggaccct

SEQ ID NO: 284339 - DNA, 973 bp, Homo sapiens
ggctggaggctcagcgcgcaagcgtgcgcgtgatttggccctgaacggacgccgtagccaagaggttgggcggatgttgtgagccgggtcgctgcggccgaggctccggcccccaggaccactggctgcccatgagagatgaaggatggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggaaacccctgaacttccagaacctgccagaacatttggaccagttgctacaggtggacaatgaggaggaggaaagccagggacaggttgaagggcggcttggcccatccactgtggtcctggaccacacaggcggctttgaggggcttctcctggtggatgatgacctgctgggggtgattggacacagcaactttggcaccatccgctctaccacatgcgtgtacaaagggaaatggctctacgaggtcctcatctcctcccaggggctcatgcagatcggctggtgcaccatcagctgccgcttcaaccaggaggagggggttggagatacacacaactcctatgcctatgatggcaaccgcgtgcgcaagtggaatgtgaccacaacgaattatggcaaggcgtgggcagcgggggacatcgtgagctgcctgattgacctggatgatggcactctgtccttctgctgacggtgtattccctgggcactgcctttgggaccctgccgggctggtattgggtacttccagacataacccttttcaggggccggggctcatctgggcagcggcttggccacccaggaggaccggcctggggcccctgttctgcccgctcttcttgtctgcttctctcgggtcttactccgctcaggggta

SEQ ID NO: 284340 - DNA, 1462 bp, Homo sapiens
agttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaaggtcagcccgccttgggcacggggtagggtgggaggtgtgtgtgtgcacatgagggtgcttggaggtgcccatgtctaggtgggacttggggaaccctggtggtggagccctggcccaaacctgccccccatctcctggagcctgagggccatgttcctcacctgacctccagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagaccaccacatccaacctccttgcctgcctgtatcctcattggtgggagcccagccatggccctaattgtgcctgagcttgactttcagtcagggccacagtgagcattaaattattattccata

SEQ ID NO: 284341 - DNA, 691 bp, Homo sapiens
ggctggaggctcagcgcgcaagcgtgcgcgtgatttggccctgaacggacgccgtagccaagaggttgggcggatgttgtgagccgggtcgctgcggccgaggctccggcccccaggaccactggctgcccatgagagatgaaggatggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggaaacccctgaacttccagaacctgccagaacatttggaccagttgctacaggtggacaatgaggaggaggaaagccagggacaggttgaagggcggcttggcccatccactgtggtcctggaccacacaggcggctttgaggggcttctcctggtggatgatgacctgctgggggtgattggacacagcaactttggcaccatccgctctaccacatgcgtgtacaaagggaaatggctctacgaggtcctcataccaccacatccaacctccttgcctgcctgtatcctcattggtgggagcccagccatggccctaattgtgcctgagcttgactttcagtcagggccacagtgagcattaaattattattccata

SEQ ID NO: 284342 - DNA, 168 bp, Homo sapiens
gaaaaatggagcccaatcccttgcctgctccaggcactagagggcccttcctaggctgcctgcaggatcagggtggacctgggtatggggccatgtcttgattgtcctcctttccccttgggtggcagaggaaggacatccttgcagagttgaccaagagccagaagg

SEQ ID NO: 284343 - DNA, 249 bp, Homo sapiens
gtcccacccaatcccaggcaccccagctcagagaatacctcttactctttccctcagatcatctgttcccttctgtagagccatatgcatccaaggctggtgattggtgggctctggcccagaccctgcctgcctcaccagggacctcataggcatttcctccctaggagggggttggagatacacacaactcctatgcctatgatggcaaccgcgtgcgcaagtggaatgtgaccacaacgaattatg

SEQ ID NO: 284344 - DNA, 2433 bp, Homo sapiens
acttccttcgtctgggtggttgccccagcgacacgttgggccgaagagcggtgttgggtacccgagagacccggcggtggggaagtcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcaccttggccaaggagtatgttaaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccaggagtggttagaaaagaaaaatgtatatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataatgatagaaattattccttttgtggatgattgt

SEQ ID NO: 284345 - DNA, 2602 bp, Homo sapiens
acttccttcgtctgggtggttgccccagcgacacgttgggccgaagagcggtgttgggtacccgagagacccggcggtggggaagtcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcaccttggccaaggagtatgttaaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtatatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataatgatagaaattattccttttgtggatgattgt

SEQ ID NO: 284346 - DNA, 1112 bp, Homo sapiens
acacaccatgatcgatcgagctcggtcctggttagcagatacataagggcagctgtttatcagtgagtggttagaaaagaaaaatgtatatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataatgatagaaattattccttttgtggatgattgt

SEQ ID NO: 284347 - DNA, 389 bp, Homo sapiens
gaggaaactgttgccgagaaaaagaaagataatttaactgctgttgagaaatggtaatccaaaatcataaatattttgatatattttaaattatagtaacacttcaggattttataaaatttatttacttgaaatttagtaatgcatttcaatttcattactgtcaaagatgtactagggaatctttattatgtattttcctttaactctccagtgttttatactatgctctataggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggtaggtattatttgtcaatg

SEQ ID NO: 284348 - DNA, 711 bp, Homo sapiens
taggagagcccggagccggatccactctcagcctcaggaagcagcagcctccgctccgcggcgggtgtgctcggcagtcacagacccactcaggacacctcccgttgccgacgggctagacctgccttaaaggggtccccgtgtctctccagtctagagcctaagttcaaacgaggcgtataggcgaggacagcaggaaggctccaagtcaaacaaacggatgggaagtggtcttgggaaacctgaagacactgggatattcagaaggccaaggggatccagcttatcctgttgggcaaggtgctgggagtgaaggcaggtcacctgaatgatactggtgccatttctgaagttggtgaaactccgcattacatcctgactcagagattccactgatgatttccaggaactaccaaagccacggatcagctgagttacccgggctaatagcaggaggaaacagtgtcagagagggatctggctgatcttcaactccactaagttctccccaagggtcttgctccatcacccacgctggagtgcagtggcacaatcacagctcactacaacctcaactttcctggctcagtgattatcccacctcagcctcctgagtagctgggactaacaggcatgtgccaacatgtcccactcattttttttttattttttgtagagatggggtttcaccatgttgtccaggctggtctc

SEQ ID NO: 284349 - DNA, 101 bp, Homo sapiens
gataagtgtcatgtcatactaaatatttattttctgcagactgacttcggagtaattcttgagccaggaggggagaggttagtgttcaaattgctgagatc

SEQ ID NO: 284350 - DNA, 361 bp, Homo sapiens
gatgggggatctgagtggggcctgggacttgcaggtcacctgaatgatactggtgccatttctgaagttggtgaaactccgcattacatcctgactcagagattccactgatgatttccaggaactaccaaagccacggatcagctgagttacccgggctaatagcaggaggaaacagtgtcagagagggatctggctgatcttcaactccactaagttctccccaaggtatagccatccttatcatcaaaccctcttttctggtattctctcaatccagtctttcatactctattcccccaccatgtaatctgcatcctttcatttttcttttccacttcccttaccactgatcccatca

SEQ ID NO: 284351 - DNA, 603 bp, Homo sapiens
actaaatatttattttctgcagactgacttcggagtaattcttgagccaggaggggagaggttagtgttcaaattgctgagatcttaggtcaaaaagctacagaaaagaaatcactttgaaaaacacaatgactcagaggcagtcaccccttgccagcaattccaagagctgaggaggcttcatgcctcaggacatggtgactagttgagtgaaccagagattgaggcagtggtttttacaggggaagaaacaagccttgggtgtatgggagcaggaaaggagggtgacagactggagaaatgataaaggccattttggaagcccacagggaagtggtcttgggaaacctgaagacactgggatattcagaaggccaaggggatccagcttatcctgttgggcaaggtgctgggagtgaaggcaggtaagccatgtcaagggcctgggaagcaaggggaaaactggaaggggtaccccaggtgaagaagggtatggaatggggtgcagaagtccatggagatgaccggcagatctcagggcggtttctggcacatcagaagttgggcttatgcttcttgagctccaccataaggtggtgaatg

SEQ ID NO: 284352 - DNA, 689 bp, Homo sapiens
ttgagacaagttctcattctgttgcccaggctggactgcagtggtgagatcacagctcactgcagcctcagcctcctggactcaagggattctcccacctcagtctcccaagcagccgggaatacaggtgtgtgccaccatgcagagctgattttttttttttttttttcctgtggagatggggatctcacaatgttgccaaggctcatcttgaactcttagcctcaagtggtcctcctgccttagcctctcaaagtgctgggattacaggcgtgaaccaccacacctggctcttttacaattttagttcattttaaccctcagtacaccaagaaaaacagtcatcatcatttatcatctgggtccaaaagacattttattaatatttaagttaattcatgaataatttacacaataagaataaagaataaaaaggctagtcatatcgtacataaatgtaagttatcaatattacaaaaaggaacaaattatccagaagacagttaagcctaaagtactcataagccatgtggaggagcgtgaagaactttccttaaattatatagtcctgcaaaataaaaaggattatggccaatttacctagtaaccaatacaattgcttatgaacttttaaaaaagaacatggtcattttattaattcttatattttataaattttgacatacccc

SEQ ID NO: 284353 - DNA, 827 bp, Homo sapiens
attcttactgaactcccaatctgcttcaagatctgtcttaggattggtgaattatgttcatttttaaaaagggatgtgatagacaacatctagagaaacaggcaaggagtatatatctgaaaaggacaaggcgctttgaaactgacagctcatcaacaggttcatggatgaacctggaaatatttataaatattgattccagatttcagagacggggtttcgaaatgttgcccaggttggtctagaactcccggactcaagtgatcccccgaccaggcctcccaaagtgctgggattatcggtgtgagccaccaacccctgcagagtctacatctgaaataaaccacagaagcaaggatatcacttaaacaatgtaacttaccaattcagtctgagtgagttttgtagtttataacatattgatgaaaacagttaagtgtccacattccgtttacataagagaatgctattcaagcttttaaaataaaaaacttaaactattcccctcaccccccaaaaagtctaactataaagatgggtttgctacaaaataattagcaaaactgatttaccaagtaagatgtcctcccgctcactgccccccagaaatacgtatactgtaggaatactcctaggaagtgacacaagtgaaagaaagaatattctttcaatatgctaaaaacatctacagtgcactaaaaaaaagtccctaaatttggcaatacatttcttccaaaaatgttattcaataacataaacattatgaagtagaactggctgtcccatatgttcagaataaaagggttaagtggagtcctgcataacta

SEQ ID NO: 284354 - DNA, 1243 bp, Homo sapiens
ttgagacaagttctcattctgttgcccaggctggactgcagtggtgagatcacagctcactgcagcctcagcctcctggactcaagggattctcccacctcagtctcccaagcagccgggaatacaggtgtgtgccaccatgcagagctgattttttttttttttttttcctgtggagatggggatctcacaatgttgccaaggctcatcttgaactcttagcctcaagtggtcctcctgccttagcctctcaaagtgctgggattacaggcgtgaaccaccacacctggctcttttacaattttagttcattttaaccctcagtacaccaagaaaaacagtcatcatcatttatcatctgggtccaaaagacattttattaatatttaagttaattcatgaataatttacacaataagaataaagaaatgacacaaaacaacttcactgattttttttcataagaatttaaacataacattgtaattcaattcttcattccctgttttcctggttttgaaggagtatatatctgaaaaggacaaggcgctttgaaactgacagctcatcaacaggttcatggatgaacctggaaatatttataaatattgattccagatttcagagacggggtttcgaaatgttgcccaggttggtctagaactcccggactcaagtgatcccccgaccaggcctcccaaagtgctgggattatcggtgtgagccaccaacccctgcagagtctacatctgaaataaaccacagaagcaaggatatcacttaaacaatgtaacttaccaattcagtctgagtgagttttgtagtttataacatattgatgaaaacagttaagtgtccacattccgtttacataagagaatgctattcaagcttttaaaataaaaaacttaaactattcccctcaccccccaaaaagtctaactataaagatgggtttgctacaaaataattagcaaaactgatttaccaagtaagatgtcctcccgctcactgccccccagaaatacgtatactgtaggaatactcctaggaagtgacacaagtgaaagaaagaatattctttcaatatgctaaaaacatctacagtgcactaaaaaaaagtccctaaatttggcaatacatttcttccaaaaatgttattcaataacataaacattatgaagtagaactggctgtcccatatgttcagaataaaagggttaagtggagtcctgcataacta

SEQ ID NO: 284355 - DNA, 381 bp, Homo sapiens
tctctgaccaacattttctcctctattctaaatattgtacacagcccaaaggaagtcagtcttgttttgttttgtatgctttcagacaggtctcactctgttgcccaggcctgagtgtggtggtgtgaccatgactcactgcagcctgaaactcctgggctcaagcaatcctcccacctcagcctccggaatagacggggactatagttgcgtgccaccatgcttggctaattttacatgtttgtttgtttgtttatagagacggggtttcgaaatgttgcccaggttggtctagaactcccggactcaagtgatcccccgaccaggcctcccaaagtgctgggattatcggtgtgagccaccaacccctgcagagtctac

SEQ ID NO: 284356 - DNA, 308 bp, Homo sapiens
aagatgtcctcccgctcactgccccccagaaatacgtatactgtaggaatactcctaggaagtgacacaagtgaaagaaagaatattctttcaatatgctaaaaacatctacagtgcactaaaaaaaagtccctaaatttggcaatacatttcttccaaaaatgttattcaataacataaacattatgaagtagaactggctgtcccatatgttcagaataaaagggttaagtggagtcctgcataactagcaaagtggaagaataaatggtaagattaagacatacacatacaaacattaaaatcta

SEQ ID NO: 284357 - DNA, 3158 bp, Homo sapiens
ggaaacacaagcccggcctcggcgcgccatgtgtggtaacacgctcagccgctgccacgctatttaaacgcgggctatggatccaggaaccggcgcgaatcaatgagatcaaatgcgagggagatgcaccgtcaattacaaacacttggacaagtctaactttttttttcttctacaaaaacgctttcaaaagcaaccttagcaacgcccaaataagaagccacctctaagcaaaatagtatatgtataaacggagggcgaatatatacaagtatatatatatgtatattacagacgcacaggtttacacccggtgaactttttctttttctttttctttttcctttttttttaagaaaaactagtgacattgcagagaaggacgcttcctctctatcttttggcgcattagtgaagggggtattctattttgttaaagcgcccaagggggcgcagggaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctctagagctggaggacaggtttgtggttgaggacttctctgtccgatgtctacattcaggttctgacttcatatcttgaaaaaggatttcctccctgtctttttcagtgtctcataaacgctactctggattgttgtaaatattagtgagatgggaggatttacagaagaaaagcaagtcaaaaatatttcctttttgatgtaaaaaaaaaaagccctatttcgcactaacattttattttacaagtattttaatcttatattttggtattagaaaaatttgtctattttttcattttgaagattaaatgttgcttacattttaaaagcatgggtgaagtgtacaacaaaccaataatgataaaaaatccttctctttttctccctgtttccctttttcccttggccacagccaaatgctaattgctgctttaattacagagatgtgtaaatgtattcagattacaaactctacaggaatacatcaacattttaactcttt

SEQ ID NO: 284358 - DNA, 900 bp, Homo sapiens
gcttctttgcgtggcagcatggcagagggatgtgctgtgtacggaacctggccctggggagggatgttccagctgttccggccttctgcccttgctggcctctgctccataggactggtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcttaaaaggaatcgggagtgacagaattgcgtgaggggcttactcagagcggttggaaatggcctctacattttcaggcgaacttcgaataccattggaggcgaaccagagaaagaagtac

SEQ ID NO: 284359 - DNA, 1897 bp, Homo sapiens
gaagccgcatggatgagaactgagatgttccagctgaccaccccgggtattctccagacattggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctctagagctggaggacaggtttgtggttgaggacttctctgtccgatgtctacattcaggttctgacttcatatcttgaaaaaggatttcctccctgtctttttcagtgtctcataaacgctactctggattgttgtaaatattagtgagatgggaggatttacagaagaaaagcaagtcaaaaatatttcctttttgatgtaaaaaaaaaaagccctatttcgcactaacattttattttacaagtattttaatcttatattttggtattagaaaaatttgtctattttttcattttgaagattaaatgttgcttacattttaaaagcatgggtgaagtgtacaacaaaccaataatgataaaaaatccttctctttttctccctgtttccctttttcccttggccacagccaaatgctaattgctgctttaattacagagatgtgtaaatgtattcagattacaaactctacaggaatacatcaacattttaactcttt

SEQ ID NO: 284360 - DNA, 4301 bp, Homo sapiens
agcggggaagtgacgtcggagtgtcaacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacactgggctcccagacgatc

SEQ ID NO: 284361 - DNA, 5544 bp, Homo sapiens
  misc_feature (478)..(478): n is a, c, g, or t
  misc_feature (1002)..(1002): n is a, c, g, or t
  misc_feature (1024)..(1024): n is a, c, g, or t
  misc_feature (1063)..(1063): n is a, c, g, or t
  misc_feature (1089)..(1089): n is a, c, g, or t
  misc_feature (1104)..(1104): n is a, c, g, or t
  misc_feature (1133)..(1133): n is a, c, g, or t
  misc_feature (1152)..(1152): n is a, c, g, or t
  misc_feature (1198)..(1198): n is a, c, g, or t
  misc_feature (3151)..(3151): n is a, c, g, or t
agaaaaaccatccctaggaaagtttcagaagtgtttcagctaagacaaggactccctaaactaggtttgccttacagagttctttgccacaaaggaacaaagtgatttggctagtagggggattactttcaacaattaatttttttgctttaaatatgttccccaacaacctcttggtaaccttactaaaaaaagattgaatattcttttacatttctaattaatcttgaaaaaatattttattttcctcacttaaaagtaattaggatcctcacaaaccccacacggcctaactaggtaatacaaggttaggctgagcatggtggcccacgcctgcaatcccaacaatttcggaggccaaagtgaaaggattccttgagtccaggagttcgagaccagcctgggcaatgtgacaataccctgtctctgcaaaaaaaaaaacttaaaaattagctgggcatggtggcacacacctgtngtcccagctactcggggagctgaggtgggaggatcacttgattgagtatgggaggttgaggctgagtgagccgtgatcacaccactgcattccagcttgggcaacagagggagaccttgtctcaaataaataaataaagataataaaattggtgttaaaactatgaagacaacatgctccccttcaaagatttccctttcttaagcagggaacagggtttaaatatgtgtaaagataaatccccaggcaaatggtaacgagcccttttagtattttgttggaacacctatattgtgaatgacagagaaaagaagaatcagggaagaaaaaaagagcatttattgatcttctaattatgtgccatacgctctttgcattttcatatccaatgtgattttaattttcagtgtccctcaaggtacctattaggatccattttcttttttttctttttttttttttgagatggagtctcgctctgtcacccaggctggagtgcagtggcgcgatcttggctcactgcnacctcttgactcctggcttcantcaattttcctgcctcagcctcctcagcagctgggactncaggcacacgccaccacatccagctnatttttataattttngtagagacggggtttcaccatgtgggtcnggctggtctcaaacttctngactcagataatccaactgccttggcctcccaaagtgctggtattncaggcgtgagccaccgcgcctggccagatccattttcatagatgagaaaatgggctcagagaaacccatggttatgtggctaggaagtgacagagaattagtacccagcccaacttgaaaaccctagtgctagaccttgtatttttaaaagtttgtgtctttttagcaagttttacaagtctgatattcagttcagaaaaagaaccactactttatgcgcctataacttcagtctggcaggctttgaattctttagccaatggaccatgcagtggtggccaaatgtcaaaagcatgaaaagtaagaaaactatgtttggctttgaaatgctttttggtacttataattgaattggaatgtctcctttctgagcattcacagtatttcaaacaaattaagaaaaacacccaaaagaactaacctgaagaatctggaaatctgcctgtcttgccccaaacatcttttttctggtcttccttttatgacaagattgaatagcattatttgtcaaacagacttgtacagagctgttctgtttgcccataaagtgtctcaaacttgcctgttttaggtgtaggatgtaactaaatactgttctttaaaaggcctctcctggttattaagccaggtaagagaagtagaatctcgaatcacctaattgaaatggtgacacaggttgtcctttctcagccgttgggtttcctttcatctctgaaggcctgtaggtaccatgaggaaaacatttaattcagagggtgaacccaacagtaggaagctgaaagcagaagtgtttatctccctctgcattcagaccaggctccttagtgcactcatcagactcattgctgcccctgctgtctgctgttgagccttcaccaccactcattcaaatccccacagcctacagattcctacaagtcatgtcctttctagtgaaccctttttaaagggttttatgtcacacacagtgcctagtccagagcttgttgccttcactttaacaaggcaaaaaaaaaaaaaatgaagtatttgtcctggaaacctaagctttcagtaagagtaaaactgtcctgaaacaaaactgtttacatctgttatctggaagcatcacctatttggtgagattctactcagaattcaggtgttagttttaatgcctagagcagtatgtcacattaattgaagaatttaaccatatctatcatttgtaatatatttcattctctcatataaactcttaggatttttcttttaatttcagcaagatccatatatagcatctatggaacaccatactgattgggtaaacgacattgtactctgttgtaatgggaaaacatgtaagtatttctttggattattattgggcttctgatatattttttgttttttatataagcttttttattgaaacatacatacagaaaagtacacacacttcgagattgcagttcaacacaattttagaaagtgaatacccaaatcaagaaacaatattactagaagccctcttgtgccaccctttgccaccctttcagttattccctcttgccccaaggtaactgctcttctgtcttctgaacaccaaagggtagttttgccttcatttgaactgtatatagactcgtactatatgtattcttcttttagccttattaatacctctttttgttctaattttggtgagatccattccttggttttgcagtccgagttacaggaatttttctcaatcacattagttgagccttcaactggaacattaaaaatgtttgcactgcttgttttaaaaatatatttttttctttgaacatgtgtcttgagattttaaaaaattgaggcaatatacaataggttctagaaagagcttttaggtatgtttgtgtgtgtaagagagagaatatgttagtttgaaataatgttacattgttgtaagataagttttcaaagttntaagtcatactactaaggagtttgttaattctttgcttcttctagtaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgtt

SEQ ID NO: 284362 - DNA, 858 bp, Homo sapiens
tctgcaggttgtgcgatcactgctagtcagtttccaaaagaagctgactagcagtgagggaaccctgtctcgtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaccaaaaaaaaaaaagcagaataaacaaaaaaaaactaaaaacacacagtagagaatacaacttcaccattctgcatagaagataaaaataaaaacgagggggtccgcaccataactaagaaacacctcgagggagagacaagtcatgtttgccagacaccgtagtagtattatgacagcagatgtctcccaatgataaagatatcaaattaaactagagcgcgacggcccattatacaacacgccctcttccacacgaacaacgttccacttgtgccttttgaaagaaacaccaaatttgggg

SEQ ID NO: 284363 - DNA, 1021 bp, Homo sapiens
ggcttgaggaaggggcgggggtcggcttgcttgcccttgtggcccaggcccgggaccctcgtgggcggcattctgagcccgggattgcttgtcgccgctcttctgtaggagtggacttgcggggtcgggataggctcgttccccgcccacttgcctcccccttgccctgtctttcttcgaagcgctctgccctcgctgcgtcggagccgaggcctccaggggtttcccaggggggtgggcgttggaggagtgagcggcttgtgcgggggcgtggcgaggcggcggagcgccaacggccctgcggggtttctgctgaggattccgcacttgggagcccccagccctctcttatgtgggagctgtcccctgggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcagggagtctgatggggaca

SEQ ID NO: 284364 - DNA, 517 bp, Homo sapiens
aatatcagcacaattaaatacagtttcttcccaaatactattttgtgcttttttaatttaaattttttatagcagcagattgttattttaaaaaaggaccacattctttttgaaatgtattttagactgtttcacttagacacatgtgaaaatatgtaaaattttgaatagcaaagtcagaatcaagtgaattcaccacttaatattgatcattatactttcttttgatgtataggcatgtaaagttgaagatctgggcaaagtggattttgaagatgaaattaagaaaagatttaaaatggtgtatgtgccaaattggttctcagtagacttaaaaacaggggtaagttagcaattgatacttgtatgatttgggataattgaagattttcattatagcttataattattattagttacagagtcctgtgtttttaggtgtgaaaaaaaaaatttgtgttaaaacttaaaatgcaaaatggaataaaaaagaaaaaaacaaaattaaaaatatatt

SEQ ID NO: 284365 - DNA, 7194 bp, Homo sapiens
  misc_feature (478)..(478): n is a, c, g, or t
  misc_feature (1002)..(1002): n is a, c, g, or t
  misc_feature (1024)..(1024): n is a, c, g, or t
  misc_feature (1063)..(1063): n is a, c, g, or t
  misc_feature (1089)..(1089): n is a, c, g, or t
  misc_feature (1104)..(1104): n is a, c, g, or t
  misc_feature (1133)..(1133): n is a, c, g, or t
  misc_feature (1152)..(1152): n is a, c, g, or t
  misc_feature (1198)..(1198): n is a, c, g, or t
  misc_feature (3151)..(3151): n is a, c, g, or t
agaaaaaccatccctaggaaagtttcagaagtgtttcagctaagacaaggactccctaaactaggtttgccttacagagttctttgccacaaaggaacaaagtgatttggctagtagggggattactttcaacaattaatttttttgctttaaatatgttccccaacaacctcttggtaaccttactaaaaaaagattgaatattcttttacatttctaattaatcttgaaaaaatattttattttcctcacttaaaagtaattaggatcctcacaaaccccacacggcctaactaggtaatacaaggttaggctgagcatggtggcccacgcctgcaatcccaacaatttcggaggccaaagtgaaaggattccttgagtccaggagttcgagaccagcctgggcaatgtgacaataccctgtctctgcaaaaaaaaaaacttaaaaattagctgggcatggtggcacacacctgtngtcccagctactcggggagctgaggtgggaggatcacttgattgagtatgggaggttgaggctgagtgagccgtgatcacaccactgcattccagcttgggcaacagagggagaccttgtctcaaataaataaataaagataataaaattggtgttaaaactatgaagacaacatgctccccttcaaagatttccctttcttaagcagggaacagggtttaaatatgtgtaaagataaatccccaggcaaatggtaacgagcccttttagtattttgttggaacacctatattgtgaatgacagagaaaagaagaatcagggaagaaaaaaagagcatttattgatcttctaattatgtgccatacgctctttgcattttcatatccaatgtgattttaattttcagtgtccctcaaggtacctattaggatccattttcttttttttctttttttttttttgagatggagtctcgctctgtcacccaggctggagtgcagtggcgcgatcttggctcactgcnacctcttgactcctggcttcantcaattttcctgcctcagcctcctcagcagctgggactncaggcacacgccaccacatccagctnatttttataattttngtagagacggggtttcaccatgtgggtcnggctggtctcaaacttctngactcagataatccaactgccttggcctcccaaagtgctggtattncaggcgtgagccaccgcgcctggccagatccattttcatagatgagaaaatgggctcagagaaacccatggttatgtggctaggaagtgacagagaattagtacccagcccaacttgaaaaccctagtgctagaccttgtatttttaaaagtttgtgtctttttagcaagttttacaagtctgatattcagttcagaaaaagaaccactactttatgcgcctataacttcagtctggcaggctttgaattctttagccaatggaccatgcagtggtggccaaatgtcaaaagcatgaaaagtaagaaaactatgtttggctttgaaatgctttttggtacttataattgaattggaatgtctcctttctgagcattcacagtatttcaaacaaattaagaaaaacacccaaaagaactaacctgaagaatctggaaatctgcctgtcttgccccaaacatcttttttctggtcttccttttatgacaagattgaatagcattatttgtcaaacagacttgtacagagctgttctgtttgcccataaagtgtctcaaacttgcctgttttaggtgtaggatgtaactaaatactgttctttaaaaggcctctcctggttattaagccaggtaagagaagtagaatctcgaatcacctaattgaaatggtgacacaggttgtcctttctcagccgttgggtttcctttcatctctgaaggcctgtaggtaccatgaggaaaacatttaattcagagggtgaacccaacagtaggaagctgaaagcagaagtgtttatctccctctgcattcagaccaggctccttagtgcactcatcagactcattgctgcccctgctgtctgctgttgagccttcaccaccactcattcaaatccccacagcctacagattcctacaagtcatgtcctttctagtgaaccctttttaaagggttttatgtcacacacagtgcctagtccagagcttgttgccttcactttaacaaggcaaaaaaaaaaaaaatgaagtatttgtcctggaaacctaagctttcagtaagagtaaaactgtcctgaaacaaaactgtttacatctgttatctggaagcatcacctatttggtgagattctactcagaattcaggtgttagttttaatgcctagagcagtatgtcacattaattgaagaatttaaccatatctatcatttgtaatatatttcattctctcatataaactcttaggatttttcttttaatttcagcaagatccatatatagcatctatggaacaccatactgattgggtaaacgacattgtactctgttgtaatgggaaaacatgtaagtatttctttggattattattgggcttctgatatattttttgttttttatataagcttttttattgaaacatacatacagaaaagtacacacacttcgagattgcagttcaacacaattttagaaagtgaatacccaaatcaagaaacaatattactagaagccctcttgtgccaccctttgccaccctttcagttattccctcttgccccaaggtaactgctcttctgtcttctgaacaccaaagggtagttttgccttcatttgaactgtatatagactcgtactatatgtattcttcttttagccttattaatacctctttttgttctaattttggtgagatccattccttggttttgcagtccgagttacaggaatttttctcaatcacattagttgagccttcaactggaacattaaaaatgtttgcactgcttgttttaaaaatatatttttttctttgaacatgtgtcttgagattttaaaaaattgaggcaatatacaataggttctagaaagagcttttaggtatgtttgtgtgtgtaagagagagaatatgttagtttgaaataatgttacattgttgtaagataagttttcaaagttntaagtcatactactaaggagtttgttaattctttgcttcttctagtaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacactgggctcccagacgatc

SEQ ID NO: 284366 - DNA, 4588 bp, Homo sapiens
ggcttgaggaaggggcgggggtcggcttgcttgcccttgtggcccaggcccgggaccctcgtgggcggcattctgagcccgggattgcttgtcgccgctcttctgtaggagtggacttgcggggtcgggataggctcgttccccgcccacttgcctcccccttgccctgtctttcttcgaagcgctctgccctcgctgcgtcggagccgaggcctccaggggtttcccaggggggtgggcgttggaggagtgagcggcttgtgcgggggcgtggcgaggcggcggagcgccaacggccctgcggggtttctgctgaggattccgcacttgggagcccccagccctctcttatgtgggagctgtcccctgggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacactgggctcccagacgatc

SEQ ID NO: 284367 - DNA, 4319 bp, Homo sapiens
cggctaggatacgagggcccgggtgttgaaatcgggtcagaagattaccgtgagaacatatactagtggcggtgcgagagatgcgaggttccgatgtgatcagtaggatgatagtgggagaacctggaaccgactatggagtcacatgcgtcggcagatgggtcgagcactaaatagagagtccacatgccggtcgagtacgctatcgataagaagatgtgagtgacaatctcgaacacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacactgggctcccagacgatc

SEQ ID NO: 284368 - DNA, 4171 bp, Homo sapiens
agcggggaagtgacgtcggagtgtcaacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataagcttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacactgggctcccagacgatc

SEQ ID NO: 284369 - DNA, 3420 bp, Homo sapiens
cggttgatgtagtggttgttgaggttttcttgtttgttttttgactttatttttcttgccactttaaacaggctggcaaagcttgtagagcataacatgatcaaataacaaattttgtaattttagactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacactgggctcccagacgatc

SEQ ID NO: 284370 - DNA, 2466 bp, Homo sapiens
aactctacacgaacatattttgtcaccaagaccctacttctaacctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacactgggctcccagacgatc

SEQ ID NO: 284371 - DNA, 1778 bp, Homo sapiens
agcggggaagtgacgtcggagtgtcaacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaatatgccaattcacaaattccttcacctcacccatgcacttagggcaaacctaaacggatgcctttcatgta

SEQ ID NO: 284372 - DNA, 4179 bp, Homo sapiens
agcggggaagtgacgtcggagtgtcaacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctacttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacactgggctcccagacgatc

SEQ ID NO: 284373 - DNA, 879 bp, Homo sapiens
ggcttgaggaaggggcgggggtcggcttgcttgcccttgtggcccaggcccgggaccctcgtgggcggcattctgagcccgggattgcttgtcgccgctcttctgtaggagtggacttgcggggtcgggataggctcgttccccgcccacttgcctcccccttgccctgtctttcttcgaagcgctctgccctcgctgcgtcggagccgaggcctccaggggtttcccaggggggtgggcgttggaggagtgagcggcttgtgcgggggcgtggcgaggcggcggagcgccaacggccctgcggggtttctgctgaggattccgcacttgggagcccccagccctctcttatgtgggagctgtcccctgggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaagtaaggtgtttaaaagaaacttctttgaaagtgatccaagttaacataaataaagaatggtttataaaacattttt

SEQ ID NO: 284374 - DNA, 618 bp, Homo sapiens
  misc_feature (504)..(504): n is a, c, g, or t
caattcttatttatgtattagccaaaattattctacaaagagacatttctcctccaattcatttaccactgatagagtttacataagcaaagcacagtattataccttgaacacaccttaaaggactctttgtctccatcattcatttgaattcttagaccttatataatgtaatgtcttgatattatagcacttgccaaaggtccttgctcccaacctttttcacttcgagtctccattttacaactgttcttcctacttcgttgaaggcccttcccagtcttttttgcaaacttctctttttcatcctcatcttttgatgttaaagaggcccagcctcccaaatttatatctccagccttagcatccccacagagtcccacagccatttcaggatgtctaatattctcaggcttaacatggtctcctcttctccaaacctgcacccgttattccttctcgtctgaggagtcatcctcgtgcccgattcggcacgaggtttantggccgaaggttatgttatttcacatccacgagtcaagtatttttgctcttttttctccctctgcccccttaagacaatgtcactcaccctcccttggagaatcctgctcaacc

SEQ ID NO: 284375 - DNA, 1135 bp, Homo sapiens
ggcctcagaagcagtcagcccagggctctcggatgcagggagcctgggcccaaacagcagcttccggagtcggaaggagctgaggaagaagacagactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcgccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcaggagattattccctggcaaatgcaagttctctggcatccacaatacggcactaaagtaaaacataatagccgtctgccaaaggaagtacaactggaataaacaaaaaccctaacactggaagtgtaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcctcaaaaaaaaaaatta

SEQ ID NO: 284376 - DNA, 1120 bp, Homo sapiens
gtatcaacgcagagtggccatttgccgggggggcccaaacagcagcttccggagtcggaaggagctgaggaagaagacagactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcgccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcaggagattattccctggcaaatgcaagttctctggcatccacaatacggcactaaagtaaaacataatagccgtctgccaaaggaagtacaactggaataaacaaaaaccctaacactggaagtgtaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcctcaaaaaaaaaaatta

SEQ ID NO: 284377 - DNA, 1179 bp, Homo sapiens
ggcctcagaagcagtcagcccagggctctcggatgcagggagcctgggcccaaacagcagcttccggagtcggaaggagctgaggaagaagacagactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcgccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcagttccatggaatccatgacagcaccaactccatctttacctttcacctaaacacaagcacagcaattcagactttctctgtccctgcattccaagaaggaaagaaatcttaactgaaatggaaacagttgccaggtgcagtggctcatgcctataatcccagcactgtgggagactgaggcaggatgataatttgagcccaagagtttgagaccagcctgagcaacaaagtgagacctcttctataaaaaataaaaataaaaccagaacacagatacttaacttaagcaactttcagataagcctaactgtcaaaagtccgctgttaccattgttttaatctttcaggtttataagctttattaaataatagcaacaaaacaattaaaa

SEQ ID NO: 284378 - DNA, 785 bp, Homo sapiens
ggcctcagaagcagtcagcccagggctctcggatgcagggagcctgggcccaaacagcagcttccggagtcggaaggagctgaggaagaagacagactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcgccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtggtaagtagtttctataaaatacactattaatggggttaatatttatcgaaagtattg

SEQ ID NO: 284379 - DNA, 614 bp, Homo sapiens
ttttttaaaatgcatcttgaaagaacactttatttagtgtaagagaatagattttgtcacattaaattgaaattatgacattcaatttttatttttacctaaatggaaatattatattcatctaatcaaagatgattttcaaaattaaatataatttttgccaaagatattaagttttaaacaacacgtttttattttttgtcatagcaaagaaatgatgactttattgaattagactacaccattctacttcataatatagcatctcaggagattattccctggcaaatgcaagttctctggcatccacaatacggcactaaagtaaaacataatagccgtctgccaaaggaagtacaactggaataaacaaaaaccctaacactggaagtgtaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcctcaaaaaaaaaaatta

SEQ ID NO: 284380 - DNA, 881 bp, Homo sapiens
ttttttaaaatgcatcttgaaagaacactttatttagtgtaagagaatagattttgtcacattaaattgaaattatgacattcaatttttatttttacctaaatggaaatattatattcatctaatcaaagatgattttcaaaattaaatataatttttgccaaagatattaagttttaaacaacacgtttttattttttgtcatagcaaagaaatgatgactttattgaattagactacaccattctacttcataatatagcatctcaggtaaagtataatttacctttatttgatgccattctgaaaactgagactccttgtatagccacagtatgctttattaattttgactctaaatcagaattcatgtaaatccagataggcaccagatttaagtatattataattgcagcaatttaacaaaagtactattctttgtgaagactgttttatctctaacaaaacataaacccaactacgttttcctaaatgttttctgaattttatcatggcattaattttcttcacttgcaggagattattccctggcaaatgcaagttctctggcatccacaatacggcactaaagtaaaacataatagccgtctgccaaaggaagtacaactggaataaacaaaaaccctaacactggaagtgtaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcctcaaaaaaaaaaatta

SEQ ID NO: 284381 - DNA, 1529 bp, Homo sapiens
aaaatgactttttcttcgctagttaaaaatcaaatggatctgatgagatattacttatttaaattctgtctccctcccgtttccctctctgtatccccttaagtcttgattagaagaggcacgttacgtattgtttagttataatggtgattaagtgggatgaatcgttggataaaaatagcagttatttaaaatgcgctttaaatttcactgacttaagtgatcttttagggacccactcttcttttcatagaaattttaacagattattgtcttcaaatgaacacaaaggcacaaaaatactttttgcattcataactagaaaaacgcaaaattttaattgcagactacttgagggtaattttcgtgttttgcttttgtgtaatttagtgtgttaagagttgaatttctggagaatttgcttaaggaaatatagcatgttggaaccacagaagtgcccattttgagagctggtctcttacagttggtctccaaggtgtgttattgtagaggcataaatggtacattaccctactgtctcaagggtagagaagtttaagcattagttttgtttaactgtggcaaatgagaataaactttctaaatagtctgcttgaattggaattcatgagatttgtgctcatgaaactacttggttaaaagatagtttttaagtgaggtaggataaattactagagtttttttgaatttgagatataattattccttgaaacgtctctaatttctcttgtagatgaatttatgttcccagggtaaatcccgttaaaatttttttaaaagcttaggagagacaagaatatgtatagcttatggtgctttctaaaatatcttaaaaagagtagctaagccaatttgcataggagggagtcttgggactttaatatggataaagtaagtattccagaagccatttgtagtttttgttgaagtgttagtatggatattggtttgttgaagaaaataggctttttttctttttttgttactgtgcaaatactttaatagcaaacctgattaatatttttcagatgtagaatgtgtgagccactgtgcccagccttgtattttgatttttaaattaatttatatgaatatttccttttaccctataatgtatcagggcttaatatttttaaacttcattataaaaagttgattacagaaagtggtatcttctagttgggagccatctttgcacatctctctccaactctgcctttagtgatatgtcaataacaaattggccatggcaggagtattttacaccatggaaagtgataaatgcagcaaatcaaggaattcccctcctgttgtcccctcagaaagccagcttcccagcacctcatcaatttcaaatataaaaaaagaatagtaaattttcatgtacacatcactcagcttcagtaattgtcgtctcatagccagtttttcctctcctatcctcaaggtataccaggtacactggaggtgtattctctagcctgatacccagtggcatcgtataaaca

SEQ ID NO: 284382 - DNA, 289 bp, Homo sapiens
cggtacccggtgtttatcgatgccaccatggcaggagtattttacaccatggaaagtgataaatgcagcaaatcaaggaattcccctcctgttgtcccctcagaaagccagcttcccagcacctcatcaatttcaaatataaaaaaagaatagtaaattttcatgtacacatcactcagcttcagtaattgtcgtctcatagccagtttttcctctcctatcctcaaggtataccaggtacactggaggtgtattctctagcctgatacccagtggcatcgtataaaca

SEQ ID NO: 284383 - DNA, 5985 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcaaggagggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataa

SEQ ID NO: 284384 - DNA, 1064 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcagtgtctgtgcttgtggtcggtaacttttgctgctgttgttctgctgctgtctgccattccattcgccatctatcacgcacacagaaccctggccaggatcatgaagggcgattgaaaaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccaggtaaggccaagttggcagctgagctaaagagta

SEQ ID NO: 284385 - DNA, 700 bp, Homo sapiens
cctgtctctaaaataataaaataaaatatatatgaagtgcttaaatagtgcttaacatattataaacagtacatgtgttaactatcttatcattatgctaataattttgtacttaagagggacataacttatgttagacagttatgaatgaaatatgtataaaaacaaatctaaattttcgtgatcgagattgctaggacaggggagaaactaagggttttttgttcgcttgttttttaatgtttctgccctggtctaatatattttcttctctgaacctttagcattttttccacatatgaaaagctaaccctgtttctacaaaaactaaaaaaaatgagccaggcatggtgacttgtgcctgtagctccagctacttggaagatgggaagattgcttcagcctaggaatttgaggctgcagtgagctatgattgtaccactgcactccagcctgggtgacagagtgagactatgtctcaaaaggaaaaaaaaaagaaaagaaaagaaatgaaaaagaaaaactaccacatttgttaaagtaacatcaacttattgcctgactacattttaaactaacatgcaagtatggtcagctttggtgtgaaatttttcaatatgaaaataaaaagttttctgacagggcgttttgaagaaacatttaatagtcaaaatggcataatcatatgactgggaagagg

SEQ ID NO: 284386 - DNA, 534 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcagcttcgcttggctggcgagcgcatctgctgctggggttcgcggtgcagatggagacgcagtggtggccagagggtgatggagaagacgggaaaagcgacagccacgctcctggctgaagccgcaggacgcaaataacttactttgtacctgacagtttctcacgttgttgtggaggccctgtttcctggaaataaactcaaattgttgttttctg

SEQ ID NO: 284387 - DNA, 6396 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcaaggagggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataacaaaaaaaaaaaaaaaaaaaaaaaaaaaaaaaaaacatctttgcgcggcgcgcgcccgggccccgggaaaaggcttttcaaaacacaccgcgggtgggggcgcgcgggggccccggggggaagagggaacacggggcccaaagcgggtctcccaagagaagaaacccgcgggacacagagaaaaaggcgcgcggggactttctccccccataaaaacaacgcgccgcggggcggaaacccgagagaggggctaccgagagaacacatcctccacagagatgagggagcttttgagagagcgcgacatataacacggggagacctatatattacacaaccgagggaggcaccaagaggagagagcccgcgcgaaatatcaaagattaaagcgcccccggggaccagggggga

SEQ ID NO: 284388 - DNA, 5268 bp, Homo sapiens
tgggataggaaccgaaggagaaggatcttactgaagtggaaggttcaccatgaggagtggaggactatacaagcctggcagtcatggaagttcaaggattgctttttatcgatatctagaaataatttacttctctttctgtgcaagaacaatatgctctcctgtttgcagagctgccccttcagtgtgtttctagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcaaggagggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataa

SEQ ID NO: 284389 - DNA, 4292 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataa

SEQ ID NO: 284390 - DNA, 2442 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaacccagtgcgtacgcattgctacataagcagcagctacacgagaaccagtacttagg

SEQ ID NO: 284391 - DNA, 1140 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagattttcagactgtgattgacagaaggtaactgcaactgcccaaagtgcgaccttggataaggaaggatgtctgtattcctgaggaacgttcaatgatacggaatttgtgattcataacttgaagctatgataaagctctacttatgggaaataagatcaaaagtgaaattataacatataatttatactgaaatgaaataataaaaagcatttggttatattcttga

SEQ ID NO: 284392 - DNA, 347 bp, Homo sapiens
accaggatctgtatgatgactttgaatgggtgcatgttagtgctcaagagcctcattatctaccacccgagatgccccaaggtgagagtcactctgtttagtcagtgttgggggaatagttttgcagtatctatgattttcttatttaaagtgtaacaacaataatttaatggttataataagctaaattattgtgctactggatcacttctaagagccttattctttgcctttcccttaataactttctgtaattctgtattccttgttgtctttgaaaaaaaaaagataagtattagtgtttttttctatttaataaaaacccaagtgacaaaccaaaaatcaaa

SEQ ID NO: 284393 - DNA, 748 bp, Homo sapiens
ctttttttcttttccccaaagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcattttttccacatatgaaaagctaaccctgtttctacaaaaactaaaaaaaatgagccaggcatggtgacttgtgcctgtagctccagctacttggaagatgggaagattgcttcagcctaggaatttgaggctgcagtgagctatgattgtaccactgcactccagcctgggtgacagagtgagactatgtctcaaaaggaaaaaaaaaagaaaagaaaagaaatgaaaaagaaaaactaccacatttgttaaagtaacatcaacttattgcctgactacattttaaactaacatgcaagtatggtcagctttggtgtgaaatttttcaatatgaaaataaaaagttttctgacagggcgttttgaagaaacatttaatagtcaaaatggcataatcatatgactgggaagagg

SEQ ID NO: 284394 - DNA, 757 bp, Homo sapiens
tagagttcgtaaattgagaactgctgctttagttcatgttctaactcaagaattccttattttaaatctcttcctgagagataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcaggtctttgagatattcccacactgtcttccacaatggttgacctaatttacactcctaccaacaagtggcttttaacagattaacaccgaatc

SEQ ID NO: 284395 - DNA, 6104 bp, Homo sapiens
  misc_feature (5994)..(5994): n is a, c, g, or t
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcaaggagggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataaaaaaaaaanaaaaaaaactctagggggggccccgttacccaatttttctcttttatggattgtatttacaattacatgggccgctggtttaaaacaatattaattgggaaaaacctggt

SEQ ID NO: 284396 - DNA, 6103 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcagtgtctgtgcttgtggtcggtaacttttgctgctgttgttctgctgctgtctgccattccattcgccatctatcacgcacacagaaccctggccaggatcatgaagggcgattgaaaaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcaaggagggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataa

SEQ ID NO: 284397 - DNA, 2821 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatgtaagtttttcattaaaattttaataaatgatgttacaactcatttcactttgaattctacacgataccttttgagtaatgagagagagtaggaaagtgaggggaga

SEQ ID NO: 284398 - DNA, 2830 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcattttttccacatatgaaaagctaaccctgtttctacaaaaactaaaaaaaatgagccaggcatggtgacttgtgcctgtagctccagctacttggaagatgggaagattgcttcagcctaggaatttgaggctgcagtgagctatgattgtaccactgcactccagcctgggtgacagagtgagactatgtctcaaaaggaaaaaaaaaagaaaagaaaagaaatgaaaaagaaaaactaccacatttgttaaagtaacatcaacttattgcctgactacattttaaactaacatgcaagtatggtcagctttggtgtgaaatttttcaatatgaaaataaaaagttttctgacagggcgttttgaagaaacatttaatagtcaaaatggcataatcatatgactgggaagagg

SEQ ID NO: 284399 - DNA, 2333 bp, Homo sapiens
  misc_feature (2249)..(2249): n is a, c, g, or t
  misc_feature (2254)..(2254): n is a, c, g, or t
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactcccccccncgtgncgaacttggcacgaccggaggctgggtggggcctcagtggggctgctgcctgacccccagcacaataaaaatgaaacgt

SEQ ID NO: 284400 - DNA, 3669 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagggcgctttcatggaactatatgatcatatgggcaacattctgttgcagtctaccttctgtctgacggatatgccatcctgaaaaaggaaagaagctgaacttcaagttcctttcatttagccttgggcttccaccttctctgtggctagaaacaggaccgtccagaagtcacctgtaactgccctatcttgcaagttctgattttggcaaaaaaaaaaaaaaaaagccttgacaaggttggattcacttctttccctggattgtgtgtcatccaactctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagcctcacaggcctcctactttgcagtcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaa

SEQ ID NO: 284401 - DNA, 523 bp, Homo sapiens
tgtccagctggtccttgggcatgaggcggggtggcactgagggtgggggtgcccgtaaccggagtccatgtttgccacacagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaa

SEQ ID NO: 284402 - DNA, 4074 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284403 - DNA, 4178 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcacttcgcctaacgctcaaacacatcaaccccaggacttccttttgtgccagctccccctcccagaagcctgggccccaccttgtcctcagtggctgagtgggaggggcaggtggagaccagacccccaccccgccccagcgagcttgtct

SEQ ID NO: 284404 - DNA, 2987 bp, Homo sapiens
agcgggaaagtcaaaagggctctttctggaagaagcgggtgcactgagttgctggtgaggttggacagggtcctggtgtccccggtctccatctgctttcctcatccacaggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284405 - DNA, 3292 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaa

SEQ ID NO: 284406 - DNA, 2057 bp, Homo sapiens
gggagaggcccctctgtggagctcggaacagtcgctttccttgcccctccccgtcctcccctccagcccggggctcccacatcccgaactaagcccctctgggagctctatggggagagcggctcctgtctcccccagaccctctggaaactcaccttggcgttttactctgcagcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284407 - DNA, 1224 bp, Homo sapiens
tgtccagctggtccttgggcatgaggcggggtggcactgagggtgggggtgcccgtaaccggagtccatgtttgccacacagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284408 - DNA, 1379 bp, Homo sapiens
ctaggctgtcctggctgtgtgcttgcactccggcctgcgcatgagagagactgactgtcggcaaaaacaaaaccaaaacaaacctttacccacttctcctaaacaacccctaaaaaactgctctgaaaagcagggaatatcattgtgcaaagtaagttgtttttttccacggggctgtctgcgtaaaacttgccacttagagccctgcctgcaccgtcgtcacggcccagcctgcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284409 - DNA, 3228 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaa

SEQ ID NO: 284410 - DNA, 3059 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagtcccgcttgccttcccctcctccgccttcctacccactccccccctcctaccttaccgcaccccttccccactccctgcctcacatctcacccaccctctcttcccccaactcaccactgccccaca

SEQ ID NO: 284411 - DNA, 656 bp, Homo sapiens
ctaggctgtcctggctgtgtgcttgcactccggcctgcgcatgagagagactgactgtcggcaaaaacaaaaccaaaacaaacctttacccacttctcctaaacaacccctaaaaaactgctctgaaaagcagggaatatcattgtgcaaagtaagttgtttttttccacggggctgtctgcgtaaaacttgccacttagagccctgcctgcaccgtcgtcacggcccagcctgcaggtgagcttcctcgcgcccccgcctgacctgagtgcccctccctcagtcagacacagtgtcgtcgccctgcaggaagccagggggcccgtctgctgctcgtggccaggctgggctttggggtgcccgaccccctccagagcaagccccttagatgcccggcaggtccctctctaccctcccatcccctgggaggtttccccagactgtgtccagtgtgaggctgaagttgagatcatagcacaggaggctctggggtccttgaagaatgaggcgcttgatgatgagcaggatctgagtgctgcctggaggaggtttgaggtcatcaatggacaggcagcttgtcccagtacttggaacttggggcagcagagctgcctagctgggcacaacctgggccaccccacaaagggcaggagtga

SEQ ID NO: 284412 - DNA, 394 bp, Homo sapiens
ctccctgacaacacaatggtgacccacgtgagtccaagaagcatccatcttatcagcgccaactgcgccccactcagaccgtgtccatgtcagcgctgacgtgtgccggacctcactgtgcagctgacacgggggcagggctttgaaaagggtccccaggtgtctggtcagacgctcgtagacagtggggcttgagtgggtcttgcagatctcattcctacctgccttcagcaggggtactggtgccttccacgtgcaggcctggcaagggttagcactggatgagatgagttcagtctggcctccagctggaggcccagggaataaatgcccagggagccagcagtgtcagtgatgggagccacacggtggggaggggatgctgagggacatg

SEQ ID NO: 284413 - DNA, 3993 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284414 - DNA, 4427 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaaccgcgtactgtgaaccttccggccccaaagccccggcccggccaggggtgggagagtctcctccagcacctcttttgtgggcccgccaccccccagcgttatccccgtgtaatgggtggaggcggaacaggccacatcacggcatcaggtctctacagcttagcaaatactgacatttttccgtttgggggatggggggaaccacttcgcctaacgctcaaacacatcaaccccaggacttccttttgtgccagctccccctcccagaagcctgggccccaccttgtcctcagtggctgagtgggaggggcaggtggagaccagacccccaccccgccccagcgagcttgtct

SEQ ID NO: 284415 - DNA, 4314 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaaaaaaaaaaaaaaaaaaaaaaaaaaaaaaaaaaaaaaaaaaaaaaaaaaaaaaacaaaaaaaacacataactcatatcactccaccaaatataaaccatgttcgcctctttggccccctctatttttaacttgccccactttttggcttcgtcctaaatttggccttccttggcccatttccccttattgggatcctttttgaacttcctggctcatgttttacaaacctcgtcctggtgg

SEQ ID NO: 284416 - DNA, 2053 bp, Homo sapiens
ggccagccttgctcagtgctgtggtgatggccacagtagcctcggggggcacagccacggctggggcagcagtcacttcctttggcgcggggcaggcagggcttaacagccggctgtcagcacacccgaccctgccgaccgcctcctctgtcctggccactgtgggcagcgggggggcctcccggccgggacgcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284417 - DNA, 3929 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagccccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284418 - DNA, 1477 bp, Homo sapiens
agtcatacagagttcctgtgtgggcttcattccttcttaaagtttagtcactgaaatttttgtttgtttgtttggctgaggcaggagaatcgcttgaaccagtgagccgagatcacgccactgcactccggcctgcgcatgagagagactgactgtcggcaaaaacaaaaccaaaacaaacctttacccacttctcctaaacaacccctaaaaaactgctctgaaaagcagggaatatcattgtgcaaagtaagttgtttttttccacggggctgtctgcgtaaaacttgccacttagagccctgcctgcaccgtcgtcacggcccagcctgcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284419 - DNA, 1817 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacctggtcaggctgcctccttaatcgagaaaactacctggtgatgcaatctttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagtttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 284420 - DNA, 1617 bp, Homo sapiens
tcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacgaagacagatgccccgccagaaggagctgccttaaatggcccagtgtgatgctgctgccgcccggccacggcccaccctggtcaggctgcctccttaatcgagaaaactacctggtgatgcaatctttttttttttaatttaatttaattttaaaataaatgctgcattggtaaagctggcagttgaaa

SEQ ID NO: 284421 - DNA, 898 bp, Homo sapiens
ggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagtagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284422 - DNA, 1847 bp, Homo sapiens
ggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaaggtcagtctgtgtgtgggacttggaggggactgggcataaaagagaaaaatgcaccacaaaaacaaagagccatatacctgaggcgggaaggtggaaggtagcccagagaacctgaactcaaatcctgagtctgccactctctgcaagattttttttgagtctcactttgtcgcccaggctggagtgcagtggtacaatctcggctcactgcaatctctgcctcttgggttcaagtgattctcctgccccagcctcctgagtagctgggattagaggcgcgcgctaccatgcctggctaatttttgaatttttaataaagacggggtttcaccacgttggccacgctggtctcgaactcctgacctcaagtgatcctcccatcttggcctcccaaagtgctgggattacaggcgtgagccacggtgcccagctctctgcaagattttgggcaagtcacttaacttccctgtgcctcactttcctcatctgtaaagtgggaataattgctacctctgggtcaatgtgagaatcaaatgagttagaatagtggcatataccattttaatgtttttatttattttttaaaatttattattattattattttttaccattttaatgtttttattaaccactcagcatccccagtgcctgacctatagtaggtgctacgtatctgcttttggaatacatgcatgaatgaatgaatgggtatgttgggtgggggagggaccaggggaagggtctgggactgaggggatgcctgggtcactgctgcccactgcctctacagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284423 - DNA, 659 bp, Homo sapiens
tctgtggtttgtgatgcagtggggagtagggttgtgcacggagtcaattgggataaatgtgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagtagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284424 - DNA, 729 bp, Homo sapiens
acttaacggttaggagaggagaaagcggcaaccggggttgtagttcatgggcttgactgcttcttttctccgcgggcgccgaccaggcctggctcgcgcctctcccaggacccgcctggctgcgagatatgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagtagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284425 - DNA, 707 bp, Homo sapiens
caggctcaagatgggcaagagcaatcaattcctacggattaccaaaaaacattccccccaacagtctattggtttgctagacatggtaaacaacccactcctggaaagactttggcaaaggccacattggtttcaggagacacagtttgtgaattacgatgatatcttgtgacaagatggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagtagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284426 - DNA, 970 bp, Homo sapiens
ggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagcatccccagtgcctgacctatagtaggtgctacgtatctgcttttggaatacatgcatgaatgaatgaatggtagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284427 - DNA, 923 bp, Homo sapiens
ggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaaggtcagtctgtgtgtgggacttggaggggactgggcataaaagagaaaaatgcaccacaaaaacaaagacccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284428 - DNA, 748 bp, Homo sapiens
ggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgagtagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284429 - DNA, 377 bp, Homo sapiens
aataggagagagtgccggggtgcatgtgtgcgtgtgtgcacaggtgtctgtggtttgtgatgcagtggggagtagggttgtgcacggagtcaattgggataaatgtgtaagaaggttggggacctgaaaggggtgttttctgggagctgatgttttggggcaaatattcaaggagtcctttgggagatgaatgtgtggaggtggaggctgggcttgcctagatggggctgtgtggcaggggacttcggggggcaggtctaggggacagaggatggggaatgtagactagagtgcagttccaggcagcactgggggtaggggatgggtgtgtgtgtgactgggaggggtgcctgggcctggataggtggtcacgcggt

SEQ ID NO: 284430 - DNA, 815 bp, Homo sapiens
tctgtggtttgtgatgcagtggggagtagggttgtgcacggagtcaattgggataaatgtgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284431 - DNA, 930 bp, Homo sapiens
cgctcaccaaactgcacaggtgcgaccctgcttccctcctggtcataactttcatgttactattgcttgggataatgttaagtaaaaatagcagacactgagttttaagtctcaagtggatgaaggcagaagcaggaagcagaaaatagtcggagagacaaaaaccaggagacccatgcgtggacagaaagactaacggagacgaaaagaaagaggcagatggggagacacgtgcgagacgagacacatgtgcatttgttggggagaagaggattggaggtgtcagtgttaaaggaacctctacaacgaaggtgaagccacggaagataaggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagtagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284432 - DNA, 969 bp, Homo sapiens
tctgtggtttgtgatgcagtggggagtagggttgtgcacggagtcaattgggataaatgtgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagcatccccagtgcctgacctatagtaggtgctacgtatctgcttttggaatacatgcatgaatgaatgaatgggtatgttgggtgggggagggaccaggggaagggtctgggactgaggggatgcctgggtcactgctgcccactgcctctacagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284433 - DNA, 1054 bp, Homo sapiens
ggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 284434 - DNA, 937 bp, Homo sapiens
ggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaaggtcagtctgtgtgtgggacttggaggggactgggcataaaagagaaaaatgcaccacaaaaacaaagagccatatacctgaggcgggaaggtggaaggtagcccagagaacctgaactcaaatcctgagtctgccactctctgcaagattttttttgagtctcactttgtcgcccaggctggagtgcatgagccgagatcgcgccactgcactccagcctgggcaacagagcgagactctgtctcaaaa

SEQ ID NO: 284435 - DNA, 5373 bp, Homo sapiens
  misc_feature (27)..(27): n is a, c, g, or t
  misc_feature (29)..(29): n is a, c, g, or t
  misc_feature (108)..(108): n is a, c, g, or t
  misc_feature (126)..(126): n is a, c, g, or t
  misc_feature (157)..(157): n is a, c, g, or t
  misc_feature (174)..(174): n is a, c, g, or t
  misc_feature (215)..(215): n is a, c, g, or t
  misc_feature (245)..(245): n is a, c, g, or t
  misc_feature (864)..(864): n is a, c, g, or t
  misc_feature (891)..(892): n is a, c, g, or t
  misc_feature (896)..(896): n is a, c, g, or t
  misc_feature (926)..(926): n is a, c, g, or t
  misc_feature (938)..(938): n is a, c, g, or t
  misc_feature (942)..(942): n is a, c, g, or t
  misc_feature (961)..(961): n is a, c, g, or t
  misc_feature (967)..(967): n is a, c, g, or t
  misc_feature (990)..(990): n is a, c, g, or t
  misc_feature (1001)..(1002): n is a, c, g, or t
  misc_feature (1016)..(1016): n is a, c, g, or t
  misc_feature (1063)..(1063): n is a, c, g, or t
  misc_feature (1427)..(1427): n is a, c, g, or t
  misc_feature (1433)..(1433): n is a, c, g, or t
  misc_feature (1463)..(1463): n is a, c, g, or t
  misc_feature (1473)..(1473): n is a, c, g, or t
  misc_feature (1542)..(1542): n is a, c, g, or t
  misc_feature (1566)..(1567): n is a, c, g, or t
ctctgtcgcccaggctggagtgcagtngngtgatctcggctcactgcaagctccacctcctgggttcacgccattctcctgcctcagccttccgagtagcttggactncaggcacccaccaccacncccagctaatttttttgtattttttttagtngagacggggttttaccntgttggccaggatggtcttgatctcctgacctcatgatccncctgcctcggcctcacaagtgctgggattncaggtatgagccaccacgcccggccaggcatttctttatagcaatgccaggatggtgtgccagactgtatcagagacaagtgatacaaagatgaccaagatacagtacttgcccaggaagaagaattcctgtggccacctctgtcttatatcaagagataagtgtgaaacagagtatccacaacagtgtttgggaagacagtgtgagtggctcccaactctaccaacaaaggcttcaaaggagtaatgacatttgaattgagtcttaaaggataaatgtattacttggcctgacaacacagaagaaaaggtcatttttgtcaaagaaatcaaccttgaaaaaatgccgcagttcatgacttgtaccagtgaaggtagcaaggtctgtgtgttggtgatgaatttgcaggggatcaggctgaagaaacaagacttgggagagaggatgtgagacctttttatgacatgcatagagttggcacctcagcctttgcatggtagggagctagctgaaggctacctccatgacagatgtacactttgaaaagacaggccgggtgcggtggctcacgtctgtaatcccagcattttgggaggctgaggtgggcaaatcacttgangtcaggagttagagatcagcctggccnncacngtgaaacctggtctctactaaaaaaaatanaataattagccnggcntggtggcgcacacctgtantcccanctattcgggaggctgaggcagangaattgcttgnncacgggaggcggangttgcagtgagctgagatggcaccaccgcactccagcctgggcgacngatcaagactccatctcaaaataaaggaagatacagctaatctatatttctttcaccagagatcaccaccactaacaattcatactggtcgtttttccctgaatgttttacctatgtaggaaaattttacatcccaatttttaatttaacactatgaaaagcatttctttttataataaagacactctattagtatacttttgatggcttcaaaactacttttgtatagatgcaaaattaaaatatcaaattgtttcttttgtttgtttgtttttttgttttttttttgagacagagtctcactctgtcgcccaggctaaagcacagtggcatgatctcggctcactgcaagcttttcctcccnggttanagtgattctcatgccgcagcctcccgagangctgggactncaggtgtgcaccaccacccccggctaattttttgtatttttacaaaacacaaagagagacggggtttcnccatgttgggcaggctggtctcannctcctgacctcaggtgatccgcctgcctcagcctcccaaagtgctgggattgcaggcgtgggccaccgtgccctgcctcaaattgtttctttaatggttgttcccaaattttcataaataactttttacgtaacatttttgggcataaagttgtctaaaattattttcataggctagataccttaagtacacttaatgatttaaatcatacttaacattaagactttaatgttgctatattgatatttagtaaaagtacaaaacttgtgctttagagtttagacatattcaggatataagatagttttgttggatttggcgaacacttgccctaggagaataaaaaatgatgaattagtccaaaatgttccagttttctaatttgtcagactcggtaaatggtatcatcaccaaccaagaaaaacagaagatacagggagagtagattttgcagaaaagataaggagttctgtttgggacttgctgcctttgatatactgcactgggagaaaatccaagtcgaacagagtggacaagtgagaatgtgctgtggaatcaacaagaggggtggggagtctacctacctagatttgagagcagtttggcaaataattgttagtaaatgtcatagaaattcgtgggagagagaagttgataagaacagaggggtaaaggatgaaacagaggaaacactgccgcttctcagggttgggtacaagagaagccagggaaatagactaagaaagagtgatcagggaaaccgggagacagtgttgtcacggaagcctggagtgtgagattttccagaaaagaaggaatgaaagaatgaatggtctgtagatccattactcagcactatcagacacattgtccccttttgatatcccataatgaaatttatagataatataatctacttgtgcacaaaattttagaaattaatataatgccccaactataatataaagtgtattagtcagggttctctagagggacagaactaataggatatatatatataaaggggagtttataaagtattaacttacactattacaaggtcccacaataggctgtctgcaagcttgaggagcagagagccaggctgagtctcaacactgaagaacttggagtccgatgttcgagggcaggaaaaatccagcacaggagaaagacgcaggctgggaggctaggccagtctctcctttccatgttcctctgcctgctttatattcactggcagctgattggattgtgcccaccagattaagggtggatctgccttccccagcccactgactcaagtattaatctcttttgacaacaccctcacagacacacccaggatcaatatttgtatccttcaatccaattaagctgacactcagaattaaccatcacataaaggaagaagtaaaaggaaagtatattttatataataagtatttaaatatgtaaacattgggacatgactaaaactgactgaacacattgaaggagtcacttggttggtctgatgtgcagaattaccatgcatgctacaaatggagaggggtctacatgagctgtattgcttgtggtgccgcagatgacttgaatttccagaatgaaaatccattcctcgctgccgaagaattaacaggatgctctccaatgaatccctccatcctcctgccttcagccgttccaactcagaagcctccgtagacagcgcctccatggaggatttctggcgggaaatagaaagtattaaagacagcagcatgggagggcaagaagagccaccgccagctgaggtcacacctgtggatgaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccgaaccttttcttcagtagaagcaaacactctgattatgaagaattactgttagcaaacactgcggcccacatcatccgcctaatgcttaagtaccagaagattttgtggaaggttccgtctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaactaatga

SEQ ID NO: 284436 - DNA, 2054 bp, Homo sapiens
agcggagtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccgaaccttttcttcagtagaagcaaacactctgattatgaagaattactgttagcaaacactgcggcccacatcatccgcctaatgcttaagtaccagaagattttgtggaaggttccgtctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaactaatga

SEQ ID NO: 284437 - DNA, 2132 bp, Homo sapiens
agcggagtattgccagagaacaggagaggaggagagtatggtataagcatgtccagaaatgaaactcgtttgtactggcagatgctataagaagagagccctgactggaaataagctaggttcaggtgtgttggccagaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccgaaccttttcttcagtagaagcaaacactctgattatgaagaattactgttagcaaacactgcggcccacatcatccgcctaatgcttaagtaccagaagattttgtggaaggttccgtctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaactaatga

SEQ ID NO: 284438 - DNA, 1941 bp, Homo sapiens
agcggagtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaacaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccgaaccttttcttcagtagaagcaaacactctgattatgaagaattactgttagcaaacactgcggcccacatcatccgcctaatgcttaagtaccagaagattttgtggaaggttccgtctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagtcatggttcatcagaatgtattaagattcagaaccaaaggttatatgaaattggaggaaatataggagagcattgcttggatccagatgcttatatattggatgtatatcgtataaatcctcaagcagaatgggtgattaaaccccaacaaagttcttaaaatatcctcgagagagctgctatcatgtattatatgccaaaaagatcctacattttggtagggaaaaaacaacactgtgtttgacgtatttgtt

SEQ ID NO: 284439 - DNA, 1252 bp, Homo sapiens
agcggagtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagtaggtggaagacgttatatgtgaatacgctaagatataaggtcaataaagtgagagcagaaga

SEQ ID NO: 284440 - DNA, 755 bp, Homo sapiens
atgaccaaaatcagcttccatgcatgaggatgatggcagctcaactcaacggccatacttaccaccttcctccaacccagggagacctgcctttttgtccttcacctgagcagtgctttcttcccaaagcttactcttatccttttccttttcttctgcagaaacatgtttcccggacttctcagataaaccctctgcaatctcttgggttcctttctccgttccttctttaagaacattctcaaagctttcgtctattggcatcggcttggtctccacatctgcttttgttatttcttggtcttcaatttcaatttctaaggattcctcaattggaagtgacacctccccatcctgacttgatgatttcttcatggagcagtggaaagaacgtagtccagaaattagaaggttttggtccatggcacagctgagcactgacaacacatccttccctgggcttattccatctgagagggagatgcacatgtatgatttcttctacggtcattctgaagatcggtgtcatcaataatttgggcttgggactatccagtttcacaggggcattcagttgattgaaaatccaatatcactattgtttatagtatcaaaacaatctaccgatcaaagtctctaaaattactacaaaaacctatttgatatcctatggcattgcccaatttaaattatttataaaatatgcagtaaatgtgtatgccagaaaatcaatgtcctaggcattgactcctaat

SEQ ID NO: 284441 - DNA, 1544 bp, Homo sapiens
  misc_feature (1232)..(1232): n is a, c, g, or t
  misc_feature (1237)..(1237): n is a, c, g, or t
  misc_feature (1372)..(1372): n is a, c, g, or t
  misc_feature (1402)..(1402): n is a, c, g, or t
  misc_feature (1529)..(1530): n is a, c, g, or t
ccagccgcccggcaccggcggagagcgcctccccgctcacctgtcgggccttgcccagggccctcgcgctggtcttggccgtcctgccgcctcctgggccaccacatcgccacagcaaggccagcggcctggccaccgctctactgccggccgccgccagcagccggtaccacatccccagacccagatcccgcgccgcccgggcgcgcgcatgcgcaatgggagagcggtcctagggccccgcgagcgcagggaggactcgcgcaggcgcggcaggggcgcggcgccggctggggccccgtcttgggtgtccacgccgtcgcctgaccgttcgagggtttgatcgccagcgcagcctcgccctgcccagacagctgggccctaaggggatagccagcgcctttagacttatcttaaatcgggcatctgcatcaacacttatttctggggtcctccatggaaagcagctcccgaaacaacacccgcccggtccgccctccgctgcactggaaaaccgcccctggacgtttctgccgcagtgtccccctcacggagttccgtttgtctgcttggtcggttgttctctggagccccaggacccaggccgcttgtatgtgcctgcggccgcacggccccaacacgcggacttcgagcggtaccgggagacccgcgcggcctcctcggagtggacagtgaagcagcagctgggctaggcagtggggctgggcctgcccatggggacccgtccacgtctccaggacatcagcctgagcctcttcgcagcctcgttttctgttgaccgagttctgcaaggggacgtagaggaaccacagcgttcttgcgcttgagaccgctgtgattttctgacattttggaggcagaaatgcctggggaaaggcccacagatgcaactgtcatccctagtgccaaaagggaacggaaagcgattacccttgacctcaaattggaagtgttacgacgatttgaagcgggtgagaagctcagtcagatcgcaaaggccttagatcttgctatctctacagtggcgaccattcgagatagtaaagaaaaaatcaaagcgagttcacaaatagctactcctctgagagcctctcggttgactcgccatcgaagtgcagtgatggagagcatggagcagctgctgagcttgtggctggaagaccagagccagccaaatgcgaccttgacgcgcatcgtaggagaagctagtngtgcntacgcggacatgcgaggtctaaacgaaggtcatgcagcagggtgctgagatcaggatgcctgttgcacttagatacagcagtcagacaggatgcacgatgtgaagtatgagaggagcacccaggctacgatgacngactgtgagtgcaggactattcagaaatgngcagtagtcaaactagcttttgagcatgactatacttggctaaccagtaggtacatcgatgcaaagtgcagttaaggtttggaaagcaatcaagcttaggctatgtataagaaacgcgcggacttgnngttggataaggggc

SEQ ID NO: 284442 - DNA, 3035 bp, Homo sapiens
ccagccgcccggcaccggcggagagcgcctccccgctcacctgtcgggccttgcccagggccctcgcgctggtcttggccgtcctgccgcctcctgggccaccacatcgccacagcaaggccagcggcctggccaccgctctactgccggccgccgccagcagccggtaccacatccccagacccagatcccgcgccgcccgggcgcgcgcatgcgcaatgggagagcggtcctagggccccgcgagcgcagggaggactcgcgcaggcgcggcaggggcgcggcgccggctggggccccgtcttgggtgtccacgccgtcgcctgaccgttcgagggtttgatcgccagcgcagcctcgccctgcccagacagctgggccctaaggggatagccagcgcctttagacttatcttaaatcgggcatctgcatcaacacttatttctggggtcctccatggaaagcagctcccgaaacaacacccgcccggtccgccctccgctgcactggaaaaccgcccctggacgtttctgccgcagtgtccccctcacggagttccgtttgtctgcttggtcggttgttctctggagccccaggacccaggccgcttgtatgtgcctgcggccgcacggccccaacacgcggacttcgagcggtaccgggagacccgcgcggcctcctcggagtggacagtgaagcagcagctgggctaggcagtggggctgggcctgcccatggggacccgtccacgtctccaggacatcagcctgagcctcttcgcagcctcgttttctgttgaccgagttctgcaaggggacgtagaggaaccacagcgttcttgcgcttgagaccgctgtgattttctgacattttggaggcagaaatgcctggggaaaggcccacagatgcaactgtcatccctagtgccaaaagggaacggaaagcgattacccttgacctcaaattggaagtgttacgacgatttgaagcgggtgagaagctcagtcagatcgcaaaggccttagatcttgctatctctacagtggcgaccattcgagatagtaaagaaaaaatcaaagcgagttcacaaatagctactcctctgagagcctctcggttgactcgccatcgaagtgcagtgatggagagcatggagcagctgctgagcttgtggctggaagaccagagccagccaaatgcgaccttgagcgccgccatcgttcaggagaaggctgagtttgatgacttacagcgtgaacatggcgaaggttctcaaacggagaggtttcatgcaagtcaagggtggcttgtgagattcaaggagtgccactgtttgccccacttcaagatgaacagcgcagctcccagcaacaaggacatgtacacagaaatgctgaaaagcatcatcgaagaaggtgagtacaccccccaggtgtctttaacgtagatgagacgagacttgattggaagagaatgcccaaaggaacgtttatttccgaggaagagaatgctgagccagggtttaagtcatccaaagatcgcttgatgctgctgcttggtggcagtgcagctggggactttaagttgaagcccttactggtgtaccgctcagaaacccgcaaggctctgaagggttcttgaagcccagtttgcccgtgatttggcgctccaacagaaaggcttgggtgaccaggagcatctttcatgaatggttcacttactttttttgccgttgaaaaatacagtgcccaaaataatctcaccaacaaagcactgctcatactagacagtgcgtcatgccactctgtaaatttgagcgacctttctgataactaagagtagaataccttcaggccaggcgcggtggctcacgcctgtaatcccagcactttgggaggccgagacgggcggatcacctgaggtcaggagttcgagaccagcctcaacatggagaaaccccgtctctactaaaaatacaaatttagccgggcgtggtggtgcaggcctgtaatcccagctactcgggaggctaaagcaggagaattgcttgaacctgggaggcggaggttgtggtgagccgagatcgcgccattgcactccatcctggacaacaggagtgaaactccgtctcaaaaaaaaaaaagaaaaaaaagaagtacaagagtataataccttcatgacagtacagctgactcaatccggaccacgtgtcaaggtgtaatctcgaccttgaaagctcattatctgagaaggacttttcagcacatcctagaagcagcggatggtgaggacacagctatgatcagggaattttggagaaactacagcatcatggatgctgtggacatggccatcgcatgggaggagctcaaaccagcactaatgaacagcatgtggaagaagatttggcctgagtgtgttcaggcccagcgtttttcccaggcagataacattgcacagcttcaaaaaaacattgtgacccttgccagaaatgtggcctttgaagaggttgctgaggctgctgtggaccagttgctgcagtcccatgaagaagatctctcaaatgaggaactgatgcggctggaacaggagctggcagtgggggaggaggagagggaagatggtccctgggcactgtggcagctaaccacaggaagactgtcggcagccctctcacattttgaggctggcttgtaggtccttgctagtaacagccctaatgatgactggaaactgagaggttccagagaaatcagtgttgcagtaaactgctagcaggagctgtacaatgagaaaaagcgccactcaaaacaactctcttaggtcatttttcaatgtgtgtaaccaaaagttaatcagaataaagcggaagcaccatgatgacctcaacagtggaggcccagccaggcctccctgctctgtggtgttggacatccctggaaaccttgctgttggtatttccattttgatacttgagagcatcaaattttgtcattaaaatgttatttaaatatatgcttttaaaagctcatata

SEQ ID NO: 284443 - DNA, 2981 bp, Homo sapiens
ccagccgcccggcaccggcggagagcgcctccccgctcacctgtcgggccttgcccagggccctcgcgctggtcttggccgtcctgccgcctcctgggccaccacatcgccacagcaaggccagcggcctggccaccgctctactgccggccgccgccagcagccggtaccacatccccagacccagatcccgcgccgcccgggcgcgcgcatgcgcaatgggagagcggtcctagggccccgcgagcgcagggaggactcgcgcaggcgcggcaggggcgcggcgccggctggggccccgtcttgggtgtccacgccgtcgcctgaccgttcgagggtttgatcgccagcgcagcctcgccctgcccagacagctgggccctaaggggatagccagcgcctttagacttatcttaaatcgggcatctgcatcaacacttatttctggggtcctccatggaaagcagctcccgaaacaacacccgcccggtccgccctccgctgcactggaaaaccgcccctggacgtttctgccgcagtgtccccctcacggagttccgtttgtctgcttggtcggttgttctctggagccccaggacccaggccgcttgtatgtgcctgcggccgcacggccccaacacgcggacttcgagcggtaccgggagacccgcgcggcctcctcggagtggacagtgaagcagcagctgggctaggcagtggggctgggcctgcccatggggacccgtccacgtctccaggacatcagcctgagcctcttcgcagcctcgttttctgttgaccgagttctgcaaggggacgtagaggaaccacagcgttcttgcgcttgagaccgctgtgattttctgacattttggaggcagaaatgcctggggaaaggcccacagatgcaactgtcatccctagtgccaaaagggaacggaaagcgattacccttgacctcaaattggaagtgttacgacgatttgaagcgggtgagaagctcagtcagatcgcaaaggccttagatcttgctatctctacagtggcgaccattcgagatagtaaagaaaaaatcaaagcgagttcacaaatagctactcctctgagagcctctcggttgactcgccatcgaagtgcagtgatggagagcatggagcagctgctgagcttgtggctggaagaccagagccagccaaatgcgaccttgagcgaaggttctcaaacggagaggtttcatgcaagtcaagggtggcttgtgagattcaaggagtgccactgtttgccccacttcaagatgaacagcgcagctcccagcaacaaggacatgtacacagaaatgctgaaaagcatcatcgaagaaggtgagtacaccccccaggtgtctttaacgtagatgagacgagacttgattggaagagaatgcccaaaggaacgtttatttccgaggaagagaatgctgagccagggtttaagtcatccaaagatcgcttgatgctgctgcttggtggcagtgcagctggggactttaagttgaagcccttactggtgtaccgctcagaaacccgcaaggctctgaagggttcttgaagcccagtttgcccgtgatttggcgctccaacagaaaggcttgggtgaccaggagcatctttcatgaatggttcacttactttttttgccgttgaaaaatacagtgcccaaaataatctcaccaacaaagcactgctcatactagacagtgcgtcatgccactctgtaaatttgagcgacctttctgataactaagagtagaataccttcaggccaggcgcggtggctcacgcctgtaatcccagcactttgggaggccgagacgggcggatcacctgaggtcaggagttcgagaccagcctcaacatggagaaaccccgtctctactaaaaatacaaatttagccgggcgtggtggtgcaggcctgtaatcccagctactcgggaggctaaagcaggagaattgcttgaacctgggaggcggaggttgtggtgagccgagatcgcgccattgcactccatcctggacaacaggagtgaaactccgtctcaaaaaaaaaaaagaaaaaaaagaagtacaagagtataataccttcatgacagtacagctgactcaatccggaccacgtgtcaaggtgtaatctcgaccttgaaagctcattatctgagaaggacttttcagcacatcctagaagcagcggatggtgaggacacagctatgatcagggaattttggagaaactacagcatcatggatgctgtggacatggccatcgcatgggaggagctcaaaccagcactaatgaacagcatgtggaagaagatttggcctgagtgtgttcaggcccagcgtttttcccaggcagataacattgcacagcttcaaaaaaacattgtgacccttgccagaaatgtggcctttgaagaggttgctgaggctgctgtggaccagttgctgcagtcccatgaagaagatctctcaaatgaggaactgatgcggctggaacaggagctggcagtgggggaggaggagagggaagatggtccctgggcactgtggcagctaaccacaggaagactgtcggcagccctctcacattttgaggctggcttgtaggtccttgctagtaacagccctaatgatgactggaaactgagaggttccagagaaatcagtgttgcagtaaactgctagcaggagctgtacaatgagaaaaagcgccactcaaaacaactctcttaggtcatttttcaatgtgtgtaaccaaaagttaatcagaataaagcggaagcaccatgatgacctcaacagtggaggcccagccaggcctccctgctctgtggtgttggacatccctggaaaccttgctgttggtatttccattttgatacttgagagcatcaaattttgtcattaaaatgttatttaaatatatgcttttaaaagctcatata

SEQ ID NO: 284444 - DNA, 2384 bp, Homo sapiens
ccagccgcccggcaccggcggagagcgcctccccgctcacctgtcgggccttgcccagggccctcgcgctggtcttggccgtcctgccgcctcctgggccaccacatcgccacagcaaggccagcggcctggccaccgctctactgccggccgccgccagcagccggtaccacatccccagacccagatcccgcgccgcccgggcgcgcgcatgcgcaatgggagagcggtcctagggccccgcgagcgcagggaggactcgcgcaggcgcggcaggggcgcggcgccggctggggccccgtcttgggtgtccacgccgtcgcctgaccgttcgagggtttgatcgccagcgcagcctcgccctgcccagacagctgggccctaaggggatagccagcgcctttagacttatcttaaatcgggcatctgcatcaacacttatttctggggtcctccatggaaagcagctcccgaaacaacacccgcccggtccgccctccgctgcactggaaaaccgcccctggacgtttctgccgcagtgtccccctcacggagttccgtttgtctgcttggtcggttgttctctggagccccaggacccaggccgcttgtatgtgcctgcggccgcacggccccaacacgcggacttcgagcggtaccgggagacccgcgcggcctcctcggagtggacagtgaagcagcagctgggctaggcagtggggctgggcctgcccatggggacccgtccacgtctccaggacatcagcctgagcctcttcgcagcctcgttttctgttgaccgagttctgcaaggggacgtagaggaaccacagcgttcttgcgcttgagaccgctgtgattttctgacattttggaggcagaaatgcctggggaaaggcccacagatgcaactgtcatccctagtgccaaaagggaacggaaagcgattacccttgacctcaaattggaagtgttacgacgatttgaagcgggtgagaagctcagtcagatcgcaaaggccttagatcttgctatctctacagtggcgaccattcgagatagtaaagaaaaaatcaaagcgagttcacaaatagctactcctctgagagcctctcggttgactcgccatcgaagtgcagtgatggagagcatggagcagctgctgagcttgtggctggaagaccagagccagccaaatgcgaccttgagcgccgccatcgttcaggagaaggctgagtttgatgacttacagcgtgaacatggcgaaggttctcaaacggagaggtttcatgcaagtcaagggtggcttgtgagattcaaggagtgccactgtttgccccacttcaagatgaacagcgcagctcccagcaacaaggacatgtacacagaaatgctgaaaagcatcatcgaagaaggtgagtacaccccccaggtgtctttaacgtagatgagacgagacttgattggaagagaatgcccaaaggaacgtttatttccgaggaagagaatgctgagccagggtttaagtcatccaaagatcgcttgatgctgctgcttggtggcagtgcagctggggactttaagttgaagcccttactggtgtaccgctcagaaacccgcaaggctctgaagggttcttgaagcccagtttgcccgtgatttggcgctccaacagaaaggcttgggtgaccaggagcatctttcatgaatggttcacttactttttttgccgttgaaaaatacagtgcccaaaataatctcaccaacaaagcactgctcatactagacagtgcgtcatgccactctgtaaatttgagcgacctttctgataactaagagtagaataccttcaggccaggcgcggtggctcacgcctgtaatcccagcactttgggaggccgagacgggcggatcacctgaggtcaggagttcgagaccagcctcaacatggagaaaccccgtctctactaaaaatacaaatttagccgggcgtggtggtgcaggcctgtaatcccagctactcgggaggctaaagcaggagaattgcttgaacctgggaggcggaggttgtggtgagccgagatcgcgccattgcactccatcctggacaacaggagtgaaactccgtctcaaaaaaaaaaaagaaaaaaaagaagtacaagagtataataccttcatgacagtacagctgactcaatccggaccacgtgtcaaggtgtaatctcgaccttgaaagctcattatctgagaaggacttttcagcacatcctagaagcagcggatggtgaggacacagctatgatcagggaattttggagaaactacagcatcatggatgctgtggacatgcgcaatgcatcgtgcataccggggtacctcatagg

SEQ ID NO: 284445 - DNA, 2982 bp, Homo sapiens
ccagccgcccggcaccggcggagagcgcctccccgctcacctgtcgggccttgcccagggccctcgcgctggtcttggccgtcctgccgcctcctgggccaccacatcgccacagcaaggccagcggcctggccaccgctctactgccggccgccgccagcagccggtaccacatccccagacccagatcccgcgccgcccgggcgcgcgcatgcgcaatgggagagcggtcctagggccccgcgagcgcagggaggactcgcgcaggcgcggcaggggcgcggcgccggctggggccccgtcttgggtgtccacgccgtcgcctgaccgttcgagggtttgatcgccagcgcagcctcgccctgcccagacagctgggccctaaggggatagccagcgcctttagacttatcttaaatcgggcatctgcatcaacacttatttctggggtcctccatggaaagcagctcccgaaacaacacccgcccggtccgccctccgctgcactggaaaaccgcccctggacgtttctgccgcagtgtccccctcacggagttccgtttgtctgcttggtcggttgttctctggagccccaggacccaggccgcttgtatgtgcctgcggccgcacggccccaacacgcggacttcgagcggtaccgggagacccgcgcggcctcctcggagtggacagtgaagcagcagctgggctaggcagtggggctgggcctgcccatggggacccgtccacgtctccaggacatcagcctgagcctcttcgcagcctcgttttctgttgaccgagttctgcaaggggacgtagaggaaccacagcgttcttgcgcttgagaccgctgtgattttctgacattttggaggcagaaatgcctggggaaaggcccacagatgcaactgtcatccctagtgccaaaagggaacggaaagcgattacccttgacctcaaattggaagtgttacgacgatttgaagcgggtgagaagctcagtcagatcgcaaaggccttagatcttgctatctctacagtggcgaccattcgagatagtaaagaatcgccatcgaagtgcagtgatggagagcatggagcagctgctgagcttgtggctggaagaccagagccagccaaatgcgaccttgagcgccgccatcgttcaggagaaggctgagtttgatgacttacagcgtgaacatggcgaaggttctcaaacggagaggtttcatgcaagtcaagggtggcttgtgagattcaaggagtgccactgtttgccccacttcaagatgaacagcgcagctcccagcaacaaggacatgtacacagaaatgctgaaaagcatcatcgaagaaggtgagtacaccccccaggtgtctttaacgtagatgagacgagacttgattggaagagaatgcccaaaggaacgtttatttccgaggaagagaatgctgagccagggtttaagtcatccaaagatcgcttgatgctgctgcttggtggcagtgcagctggggactttaagttgaagcccttactggtgtaccgctcagaaacccgcaaggctctgaagggttcttgaagcccagtttgcccgtgatttggcgctccaacagaaaggcttgggtgaccaggagcatctttcatgaatggttcacttactttttttgccgttgaaaaatacagtgcccaaaataatctcaccaacaaagcactgctcatactagacagtgcgtcatgccactctgtaaatttgagcgacctttctgataactaagagtagaataccttcaggccaggcgcggtggctcacgcctgtaatcccagcactttgggaggccgagacgggcggatcacctgaggtcaggagttcgagaccagcctcaacatggagaaaccccgtctctactaaaaatacaaatttagccgggcgtggtggtgcaggcctgtaatcccagctactcgggaggctaaagcaggagaattgcttgaacctgggaggcggaggttgtggtgagccgagatcgcgccattgcactccatcctggacaacaggagtgaaactccgtctcaaaaaaaaaaaagaaaaaaaagaagtacaagagtataataccttcatgacagtacagctgactcaatccggaccacgtgtcaaggtgtaatctcgaccttgaaagctcattatctgagaaggacttttcagcacatcctagaagcagcggatggtgaggacacagctatgatcagggaattttggagaaactacagcatcatggatgctgtggacatggccatcgcatgggaggagctcaaaccagcactaatgaacagcatgtggaagaagatttggcctgagtgtgttcaggcccagcgtttttcccaggcagataacattgcacagcttcaaaaaaacattgtgacccttgccagaaatgtggcctttgaagaggttgctgaggctgctgtggaccagttgctgcagtcccatgaagaagatctctcaaatgaggaactgatgcggctggaacaggagctggcagtgggggaggaggagagggaagatggtccctgggcactgtggcagctaaccacaggaagactgtcggcagccctctcacattttgaggctggcttgtaggtccttgctagtaacagccctaatgatgactggaaactgagaggttccagagaaatcagtgttgcagtaaactgctagcaggagctgtacaatgagaaaaagcgccactcaaaacaactctcttaggtcatttttcaatgtgtgtaaccaaaagttaatcagaataaagcggaagcaccatgatgacctcaacagtggaggcccagccaggcctccctgctctgtggtgttggacatccctggaaaccttgctgttggtatttccattttgatacttgagagcatcaaattttgtcattaaaatgttatttaaatatatgcttttaaaagctcatata

SEQ ID NO: 284446 - DNA, 1782 bp, Homo sapiens
gaagggcagtgcatcgtgtcttggtgcatagactgttccagaggtatcccgcacgttgttcattcaaggagtgccactgtttgccccacttcaagatgaacagcgcagctcccagcaacaaggacatgtacacagaaatgctgaaaagcatcatcgaagaaggtgagtacaccccccaggtgtctttaacgtagatgagacgagacttgattggaagagaatgcccaaaggaacgtttatttccgaggaagagaatgctgagccagggtttaagtcatccaaagatcgcttgatgctgctgcttggtggcagtgcagctggggactttaagttgaagcccttactggtgtaccgctcagaaacccgcaaggctctgaagggttcttgaagcccagtttgcccgtgatttggcgctccaacagaaaggcttgggtgaccaggagcatctttcatgaatggttcacttactttttttgccgttgaaaaatacagtgcccaaaataatctcaccaacaaagcactgctcatactagacagtgcgtcatgccactctgtaaatttgagcgacctttctgataactaagagtagaataccttcaggccaggcgcggtggctcacgcctgtaatcccagcactttgggaggccgagacgggcggatcacctgaggtcaggagttcgagaccagcctcaacatggagaaaccccgtctctactaaaaatacaaatttagccgggcgtggtggtgcaggcctgtaatcccagctactcgggaggctaaagcaggagaattgcttgaacctgggaggcggaggttgtggtgagccgagatcgcgccattgcactccatcctggacaacaggagtgaaactccgtctcaaaaaaaaaaaagaaaaaaaagaagtacaagagtataataccttcatgacagtacagctgactcaatccggaccacgtgtcaaggtgtaatctcgaccttgaaagctcattatctgagaaggacttttcagcacatcctagaagcagcggatggtgaggacacagctatgatcagggaattttggagaaactacagcatcatggatgctgtggacatggccatcgcatgggaggagctcaaaccagcactaatgaacagcatgtggaagaagatttggcctgagtgtgttcaggcccagcgtttttcccaggcagataacattgcacagcttcaaaaaaacattgtgacccttgccagaaatgtggcctttgaagaggttgctgaggctgctgtggaccagttgctgcagtcccatgaagaagatctctcaaatgaggaactgatgcggctggaacaggagctggcagtgggggaggaggagagggaagatggtccctgggcactgtggcagctaaccacaggaagactgtcggcagccctctcacattttgaggctggcttgtaggtccttgctagtaacagccctaatgatgactggaaactgagaggttccagagaaatcagtgttgcagtaaactgctagcaggagctgtacaatgagaaaaagcgccactcaaaacaactctcttaggtcatttttcaatgtgtgtaaccaaaagttaatcagaataaagcggaagcaccatgatgacctcaacagtggaggcccagccaggcctccctgctctgtggtgttggacatccctggaaaccttgctgttggtatttccattttgatacttgagagcatcaaattttgtcattaaaatgttatttaaatatatgcttttaaaagctcatata

SEQ ID NO: 284447 - DNA, 1470 bp, Homo sapiens
ccagccgcccggcaccggcggagagcgcctccccgctcacctgtcgggccttgcccagggccctcgcgctggtcttggccgtcctgccgcctcctgggccaccacatcgccacagcaaggccagcggcctggccaccgctctactgccggccgccgccagcagccggtaccacatccccagacccagatcccgcgccgcccgggcgcgcgcatgcgcaatgggagagcggtcctagggccccgcgagcgcagggaggactcgcgcaggcgcggcaggggcgcggcgccggctggggccccgtcttgggtgtccacgccgtcgcctgaccgttcgagggtttgatcgccagcgcagcctcgccctgcccagacagctgggccctaaggggatagccagcgcctttagacttatcttaaatcgggcatctgcatcaacacttatttctggggtcctccatggaaagcagctcccgaaacaacacccgcccggtccgccctccgctgcactggaaaaccgcccctggacgtttctgccgcagtgtccccctcacggagttccgtttgtctgcttggtcggttgttctctggagccccaggacccaggccgcttgtatgtgcctgcggccgcacggccccaacacgcggacttcgagcggtaccgggagacccgcgcggcctcctcggagtggacagtgaagcagcagctgggctaggcagtggggctgggcctgcccatggggacccgtccacgtctccaggacatcagcctgagcctcttcgcagcctcgttttctgttgaccgagttctgcaaggggacgtagaggaaccacagcgttcttgcgcttgagaccgctgtgattttctgacattttggaggcagataacattgcacagcttcaaaaaaacattgtgacccttgccagaaatgtggcctttgaagaggttgctgaggctgctgtggaccagttgctgcagtcccatgaagaagatctctcaaatgaggaactgatgcggctggaacaggagctggcagtgggggaggaggagagggaagatggtccctgggcactgtggcagctaaccacaggaagactgtcggcagccctctcacattttgaggctggcttgtaggtccttgctagtaacagccctaatgatgactggaaactgagaggttccagagaaatcagtgttgcagtaaactgctagcaggagctgtacaatgagaaaaagcgccactcaaaacaactctcttaggtcatttttcaatgtgtgtaaccaaaagttaatcagaataaagcggaagcaccatgatgacctcaacagtggaggcccagccaggcctccctgctctgtggtgttggacatccctggaaaccttgctgttggtatttccattttgatacttgagagcatcaaattttgtcattaaaatgttatttaaatatatgcttttaaaagctcatata

SEQ ID NO: 284448 - DNA, 1070 bp, Homo sapiens
gagattgtagtaggagagtatcatgggatactctctttaatatttacacagaattatgaagggatacacaagaaggtgaattccccttttaagaaatataactgttaataaaaggaaagcaattttccattttgcacaaatttaggacagaaatattcaaagagggtagtgactacagtttcttcacacttagatgagagaataaacaaatacacaacagtagtgatggtaattatcagaggaagaattattaccatatatatatttcattaaaatggatatatcttttctcatatagagaaataaaaacttgattgtgaagataaatgggtctcagcagttgctaagaaaatgactggttactttctgtcccttttgaggagcatgcagagaaattgctttagcctctgataaataaaacagactgcgaggaaaattacagcgaggaaattacagacatcatctcctttgaacagggaaaaggtaacagccagtagccagtaattggagagccaccattgtccaaaggaggagtccagctcactagcattgatcctttggtgcgtgccaaaacttttggttttcctggaggtccaggaaggcgataaggatcttgaatgactactttatctgatttgcactcatcactgattccatatttattcactgccctgactcggaactcatactgaccattggggataagtttccagatctagaaattagaaaaacagaaatttattgaagagaatatacttatgttggttttcactcatttaaaaattcaacttattttgggagggatgactgtaagaagaaataaatatatagactcaaaacatgggaagacagagaaaaggagaaagctttttttaaaataaaaatatgtagatgtattgtacctgatagtggatctcaattaaaagagtatctgtgtatcaaaaaaaaaaaaaaaaaaaaacgtttacacgtctgatgggaaccctgggtcccacttatcgcttgagaatccccttgcagtgggtatacgaaaggccgacatgcctccaaatggcaccgatgcgatggat

SEQ ID NO: 284449 - DNA, 778 bp, Homo sapiens
agggggtggtggcgaggctccgcaactttggaaactgccatttcattcacacaaggcactgcctgggggagggggctgttcctggctgcagaattctagctctcacgagcacgcagacaaccgcactcgcagcggtgtggggccggctgctcaggggaagccccaggctctccgacccagctaccgggaatggggcaccctttggagaagaaccccagcctggggtggggacgcaccggctctccgacagctcaaacacagacagatcttctagagccgagggaatttcttttcgcagaagccattactccccccgagagaaggctgcaaagctgggaagcccagggtgtgctcctcccgcccttttggacccccgggcttgcaccggctgcactctgagaaccagctgcgcgcggagcggtgcaatgcagcacccaccctgcgagcctggcaattgcttgtcattaaaagaaaaaaaaattacggagggctccgggggtgtgtgttggggaggggagaccgatgcttctaacccagcccccgctttgactgcgtgttgtgcagctgagcgcgaggccaacgttgagcaaggccttgcagggaggttgctcctgtgtaattacgaaagaaggctagtccgaaggtgcaaaatagcagggagaggacgcgcccccttaggaacaagacctctggatgtttccagtttcaaattgaaagaagaggggcgccccccttgtttgaaaataaataaataaataagtgcgagctacaaaaaaaa

SEQ ID NO: 284450 - DNA, 684 bp, Homo sapiens
gacagcgggggcgtgggcagcagctcaaacttcttccagatgtcctcccccgggggggtcgagtcggggccgccgaagtagaagtcatcttcgtccgggggcaccctttggagaagaaccccagcctggggtggggacgcaccggctctccgacagctcaaacacagacagatcttctagagccgagggaatttcttttcgcagaagccattactccccccgagagaaggctgcaaagctgggaagcccagggtgtgctcctcccgcccttttggacccccgggcttgcaccggctgcactctgagaaccagctgcgcgcggagcggtgcaatgcagcacccaccctgcgagcctggcaattgcttgtcattaaaagaaaaaaaaattacggagggctccgggggtgtgtgttggggaggggagaccgatgcttctaacccagcccccgctttgactgcgtgttgtgcagctgagcgcgaggccaacgttgagcaaggccttgcagggaggttgctcctgtgtaattacgaaagaaggctagtccgaaggtgcaaaatagcagggagaggacgcgcccccttaggaacaagacctctggatgtttccagtttcaaattgaaagaagaggggcgccccccttgtttgaaaataaataaataaataagtgcgagctacaaaaaaaa

SEQ ID NO: 284451 - DNA, 3089 bp, Homo sapiens
  misc_feature (168)..(168): n is a, c, g, or t
  misc_feature (269)..(269): n is a, c, g, or t
aaaaattagccaggcatggtggcatgcacctgtaatcccagctattcaggggtctgaggcaggagaatcacttgaacccagggggcggaggttgcagttagccgaggtcgcgtcactgcactccagcctgggcgacagagcgagactccatctcaaaaaaaaaaaaanccaccaacaaaaaaaatcactaccagttgccagctgtgataagagctaaaacaaggggtactgtagtctcaaattataaatttctattgcctcatattacnaaagttccagtcaccttaagtgattgaaggttttgacattttatccagccaggtggtagtaataagcctcaaatccacagggtacacaacattttcaaggtctttttttttttttatcatacttaattcatgaataacccccatagtgtaggttagttagcactatcaaagtgactggtaaggacgcaggaaaataaaaagaggattcaattggattggtactgcaaaaagaatccattctgttcagcacatgaatttctgttctgaccttaagtttagatatatcaaagaaacaaaaagcatagaggcggctgggggtggtggctcacacctgtaatcccagcaccttgggaggccaaggcaggcagatcacctgaggtcgggagttcgagaccagcctgaccaacatggagaaaccctgtctctactaaaaatacaaaattagccaggcatggtggcgtatgcctggaaatcccagctactcaggaggctgaggcaggagaattgcttgaacccgggaggcagaggttgcagtgagccaagatcacgccattgcactccagcctgggcaacagagcaagattccatctcaaaagaaaaaaaaaatcacctctcatctttctgtttttaggagatcaatgatctgttggttaaggaaaagattatgcaacttgtccagcagagatcacaaatccaaacccttcagaagaaggtagtaaacttggagactgctctgagttacatgaccaaagagtttgagagtgaagttttaaaactgcagcaacacgcaatgatagagaaccaagcaggtcaggtagaaattgacaagctgcagcaccttcttcagatgaaggacagggaaatgaatcgtgtgaagaagctggccaagaacatactggatgagagaacagaagtggaaagattctttttagatgctctgcaccaagtgaagcaacagatcctaattagcaggaagcattataagcagatagcacaagctgctttcaatttaaaaatgagagcagcatgtacaggaagaacagaatatcccaaaatcagaacatttgatggcagagagcacagcaccaatagtgtgaatcaggatcttctggaggccgaaaaatggacacatattgaaggaaatgtggatattggagatttgacctgggagcagaaggaaaaagtattgcgattgctctttgcaaaaatgaatggctgtccttctaggaaatacaaccagagttctaggcctccagttccagactatgttgtttctgacagtggggaaacaaaggaatttggggatgaaagtaagcttcaagataaaatcttcatcacccagcaaattgcaatatcagactcttctggtgaagtggtgctacccactattccaaaagaacctcaggagtctgacacaggaaccttctgagaagcactgattatgacctcacagatgctgctggcagtcccttccttgcagaatccttgctcctgaatatctttaagaaaatttcttaaaggaaaagacaaaaaatttaactcaaaagttacctgtttgccatagaaattggtgtctcccctgaaggaggatcgagagccggtgaatgagaacattggcaaaggcactggaatggggacattcactcccacctaaaacagaacaaatccgtgtcatatcctaaggacaaaggaactctccatttagaaacacaaaggcatcagagaccagttttaaatacccaccttctaccctatcctctaccccatgaactttcattcctgaggaagaaatggggcaatgtgggaggtcatgggggcaatcttaaaccaatgactcaccattatttactgtttcctcttaggaaatagtaaatggatataagaatctcttaaaaattctgttcacgaacctgtccaacatccaccaagtgggcatatttccgagcagtggctccattggtggtgaagatggcagttccatttccatatgggttgttatttacaatctggatggcttcatccaatgtttctgtctccagaaccacaagaactggaccaaaaatctcctctttgtaacaggtcatatttggctgccaggagtgatgcatccagaaaagaagtcagctttttggattctgagtattttatgcttatttggtactttcacttactacacatcatttacgtggacaactttcatattactaatctcttttcatttcaaatcacctatttaaaaaaaaagtcctctctcaagtgtattccgtcttccaagttaccaatcatataaacaacttggaattcctatcaacaataaccacacttcctttaagggactgtatctttagttcatgacccatcatcagctgcctttttaatacctgaacgactagtttcatccaattgttatcaaaaagttacatgaaaatttattttttataaatccaatctatagtaaatataccaggataatttttctctttacagaaaccccatgctgttttctgtaacataaataatccattcttattcactcctttgcctcccaaatatgtctgtatgtttatattttgatatcaggtcgcagacactcaaaacatccttcaccatgcaattaatgtttgttgctgataaacggatttttctgtatggttctgtggcaagagatttcataatttctactgcacttacattcaacacttgatgattcactattatagtaaggatatatgaatttcaaaaaatgcctcataacctcaatttttaagtcatgttagctgagagactttcaaagttttgataaataaaaattgacaagtc

SEQ ID NO: 284452 - DNA, 3356 bp, Homo sapiens
  misc_feature (168)..(168): n is a, c, g, or t
  misc_feature (269)..(269): n is a, c, g, or t
aaaaattagccaggcatggtggcatgcacctgtaatcccagctattcaggggtctgaggcaggagaatcacttgaacccagggggcggaggttgcagttagccgaggtcgcgtcactgcactccagcctgggcgacagagcgagactccatctcaaaaaaaaaaaaanccaccaacaaaaaaaatcactaccagttgccagctgtgataagagctaaaacaaggggtactgtagtctcaaattataaatttctattgcctcatattacnaaagttccagtcaccttaagtgattgaaggttttgacattttatccagccaggtggtagtaataagcctcaaatccacagggtacacaacattttcaaggtctttttttttttttatcatacttaattcatgaataacccccatagtgtaggttagttagcactatcaaagtgactggtaaggacgcaggaaaataaaaagaggattcaattggattggtactgcaaaaagaatccattctgttcagcacatgaatttctgttctgaccttaagtttagatatatcaaagaaacaaaaagcatagaggcggctgggggtggtggctcacacctgtaatcccagcaccttgggaggccaaggcaggcagatcacctgaggtcgggagttcgagaccagcctgaccaacatggagaaaccctgtctctactaaaaatacaaaattagccaggcatggtggcgtatgcctggaaatcccagctactcaggaggctgaggcaggagaattgcttgaacccgggaggcagaggttgcagtgagccaagatcacgccattgcactccagcctgggcaacagagcaagattccatctcaaaagaaaaaaaaaatcacctctcatctttctgtttttaggagatcaatgatctgttggttaaggaaaagattatgcaacttgtccagcagagatcacaaatccaaacccttcagaagaaggtagtaaacttggagactgctctgagttacatgaccaaagagtttgagagtgaagttttaaaactgcagcaacacgcaatgatagagaaccaagcaggtcaggtagaaattgacaagctgcagcaccttcttcagatgaaggacagggaaatgaatcgtgtgaagaagctggccaagaacatactggatgagagaacagaagtggaaagattctttttagatgctctgcaccaagtgaagcaacagatcctaattagcaggaagcattataagcagatagcacaagctgctttcaatttaaaaatgagagcagcatgtacaggaagaacagaatatcccaaaatcagaacatttgatggcagagagcacagcaccaatagtgtgaatcaggatcttctggaggccgaaaaatggacacatattgaaggaaatgtggatattggagatttgacctgggagcagaaggaaaaagtattgcgattgctctttgcaaaaatgaatggctgtccttctaggaaatacaaccagagttctaggcctccagttccagactatgttgtttctgacagtggggaaacaaaggaatttggggatgaaagtaagcttcaagataaaatcttcatcacccagcaaattgcaatatcagactcttctggtgaagtggtgctacccactattccaaaagaacctcaggagtctgacacaggaaccttctgagaagcactgattatgacctcacagatgctgctggcagtcccttccttgcagaatccttgctcctgaatatctttaagaaaatttcttaaaggaaaagacaaaaaatttaactcaaaagttacctgtttgccatagaaattggtgtctcccctgaaggaggatcgagagccggtgaatgagaacattggcaaaggcactggaatggggacattcactcccacctaaaacagaacaaatccgtgtcatatcctaaggacaaaggaactctccatttagaaacacaaaggcatcagagaccagttttaaatacccaccttctaccctatcctctaccccatgaactttcattcctgaggaagaaatggggcaatgtgggaggtcatgggggcaatcttaaaccaatgactcaccattatttactgtttcctcttaggaaatagtaaatggatataagaatctcttaaaaattctgttcacgaacctgtccaacatccaccaagtgggcatatttccgagcagtggctccattggtggtgaagatggcagttccatttccatatgggttgttatttacaatctggatggcttcatccaatgtttctgtctccagaaccacaagaactggaccaaaaatctcctctttgtaacaggtcatatttggctgccaggagtgatgcatccagaaaagaagtcagctttttggattctgagtattttatgcttatttggtactttcacttactacacatcatttacgtggacaactttcatattactaatctcttttcatttcaaatcacctatttaaaaaaaaagtcctctctcaagtgtattccgtcttccaagttaccaatcatataaacaacttggaattcctatcaacaataaccacacttcctttaagggactgtatctttagttcatgacccatcatcagctgcctttttaatacctgaacgactagtttcatccaattgttatcaaaaagttacatgaaaatttattttttataaatccaatctatagtaaatataccaggataatttttctctttacagaaaccccatgctgttttctgtaacataaataatccattcttattcactcctttgcctcccaaatatgtctgtatgtttatattttgatatcaggtcgcagacactcaaaacatccttcaccatgcaattaatgtttgttgctgataaacggatttttctgtatggttctgtggcaagagatttcataatttctactgcacttacattcaacacttgatgattcactattatagtaaggatatatgaatttcaaaaaatgcctcataacctcaatttttaagtcatgttagctgagagactttcaaagttttgataaataaaaattgacaagtcaattatttttgtcactttcaataaatattgggtggttgatatattgattgagacactgcagtagccataagctaggcagcaagagggagaggggagagaaaacattaacaaaccagtataagataagatagcgtttggcaaactatagcctgtgggccaaatgtggcttcctgcctgtttttgtacagccccaagttaaaaatggtttttgcatttttaaatggttgaaaaaaaattaatcatatataaaatgatatgaaattcaaa

SEQ ID NO: 284453 - DNA, 2811 bp, Homo sapiens
  misc_feature (168)..(168): n is a, c, g, or t
  misc_feature (269)..(269): n is a, c, g, or t
aaaaattagccaggcatggtggcatgcacctgtaatcccagctattcaggggtctgaggcaggagaatcacttgaacccagggggcggaggttgcagttagccgaggtcgcgtcactgcactccagcctgggcgacagagcgagactccatctcaaaaaaaaaaaaanccaccaacaaaaaaaatcactaccagttgccagctgtgataagagctaaaacaaggggtactgtagtctcaaattataaatttctattgcctcatattacnaaagttccagtcaccttaagtgattgaaggttttgacattttatccagccaggtggtagtaataagcctcaaatccacagggtacacaacattttcaaggtctttttttttttttatcatacttaattcatgaataacccccatagtgtaggttagttagcactatcaaagtgactggtaaggacgcaggaaaataaaaagaggattcaattggattggtactgcaaaaagaatccattctgttcagcacatgaatttctgttctgaccttaagtttagatatatcaaagaaacaaaaagcatagaggcggctgggggtggtggctcacacctgtaatcccagcaccttgggaggccaaggcaggcagatcacctgaggtcgggagttcgagaccagcctgaccaacatggagaaaccctgtctctactaaaaatacaaaattagccaggcatggtggcgtatgcctggaaatcccagctactcaggaggctgaggcaggagaattgcttgaacccgggaggcagaggttgcagtgagccaagatcacgccattgcactccagcctgggcaacagagcaagattccatctcaaaagaaaaaaaaaatcacctctcatctttctgtttttaggagatcaatgatctgttggttaaggaaaagattatgcaacttgtccagcagagatcacaaatccaaacccttcagaagaaggtagtaaacttggagactgctctgagttacatgaccaaagagtttgagagtgaagttttaaaactgcagcaacacgcaatgatagagaaccaagcaggtcaggtagaaattgacaagctgcagcaccttcttcagatgaaggacagggaaatgaatcgtgtgaagaagctggccaagaacatactggatgagagaacagaagtggaaagattctttttagatgctctgcaccaagtgaagcaacagatcctaattagcaggaagcattataagcagatagcacaagctgctttcaatttaaaaatgagagcagcatgtacaggaagaacagaatatcccaaaatcagaacatttgatggcagagagcacagcaccaatagtgtgaatcaggatcttctggaggccgaaaaatggacacatattgaaggaaatgtggatattggagatttgacctgggagcagaaggaaaaagtattgcgattgctctttgcaaaaatgaatggctgtccttctaggaaatacaaccagagttctaggcctccagttccagactatgttgtttctgacagtggggaaacaaaggaatttgggtaagagctctcttgcttaagtaataaacatgagcccaacacgatggttcttgtgggcatcttgaatgtgctaattgaaagtaatatgacaagtctgttattctaaaccaggtttcatgtgtgtagagttgttgacggttctgttattttgtcattattgcagggatgaaagtaagcttcaagataaaatcttcatcacccagcaaattgcaatatcagactcttctggtgaagtggtgctacccactattccaaaagaacctcaggagtctgacacagtaaggagtctgtatctaatcaaacaatgtatattgttgtcacccttccccatgtcgcttcttgctaaatcacggttattttctctactagttgagagacttcagggatcagtggaatgagtaataaatagcattagtagattacataaatttttaaagcaatatccgtacaaatgcatattatactaatgcaaatgcaaatgtgtgcctctttttgtgtagaaacctataggttgccttttgaagtaaacagcctagccaaaatgtgtactatcttttacgtaagagtaaacatagtgaccttgtgactcttagctttccatcacaggtgggaagtcagagtcattacaacctagaggacaaaggcttataaggagatatgaaatgatttttttaagccaagtttttctctttaagagtttttaatttataatttgttattcataattagtacaatgtagaatctgagaaatttcaaatgaagccacattagaacaaaaagaaaatactgactttttagccgcgatcacatgaatataactgatgagtttttttcatctaagaaataagaaactctgagcagcaaatagttggccagatgagttgtttctaattagagcatcacagttctgattagtgtgtttttttagaagtgatttcccttaaatataaggaatgaccttttatttaacccagcctatagttgttggattggattaaatatcactaccagggccaggtgcggtggttcacgcctgcaatcccagcactttgggaggccgaggtgggcggatcattaggtcaggagattgagaccatcctggctaacatggtgaaaccctgtctctactaaaagtacaaaaaattatccgggtgtgggggcatgcacctgtaatcccagctactcgggagactgaggcaggagaattacttgaacccaggaggtggaggttgcagtgagc

SEQ ID NO: 284454 - DNA, 650 bp, Homo sapiens
tgaaggcatgaggagacactgcctcattcattatctttgttgacttttacccactacaggaaatacaaccagagttctaggcctccagttccagactatgttgtttctgacagtggggaaacaaaggaatttgggtaagagctctcttgcttaagtaataaacatgagcccaacacgatggttcttgtgggcatcttgaatgtgctaattgaaagtaatatgacaagtctgttattctaaaccaggtttcatgtgtgtagagttgttgacggttctgttattttgtcattattgcagggatgaaagtaagcttcaagataaaatcttcatcacccagcaaattgcaatatcagactcttctggtgaagtggtgctacccactattccaaaagaacctcaggagtctgacacagtaaggagtctgtatctaatcaaacaatgtatattgttgtcacccttccccatgtcgcttcttgctaaatcacggttattttctctactagttgagagacttcagggatcagtggaatgagtaataaatagcattagtagattacataaatttttaaagcaatatccgtacaaatgcatattatactaatgcaaatgcaaatgtgtgcctctttttgtgtagaaacctataggttgcc

SEQ ID NO: 284455 - DNA, 2865 bp, Homo sapiens
  misc_feature (168)..(168): n is a, c, g, or t
  misc_feature (269)..(269): n is a, c, g, or t
aaaaattagccaggcatggtggcatgcacctgtaatcccagctattcaggggtctgaggcaggagaatcacttgaacccagggggcggaggttgcagttagccgaggtcgcgtcactgcactccagcctgggcgacagagcgagactccatctcaaaaaaaaaaaaanccaccaacaaaaaaaatcactaccagttgccagctgtgataagagctaaaacaaggggtactgtagtctcaaattataaatttctattgcctcatattacnaaagttccagtcaccttaagtgattgaaggttttgacattttatccagccaggtggtagtaataagcctcaaatccacagggtacacaacattttcaaggtctttttttttttttatcatacttaattcatgaataacccccatagtgtaggttagttagcactatcaaagtgactggtaaggacgcaggaaaataaaaagaggattcaattggattggtactgcaaaaagaatccattctgttcagcacatgaatttctgttctgaccttaagtttagatatatcaaagaaacaaaaagcatagaggcggctgggggtggtggctcacacctgtaatcccagcaccttgggaggccaaggcaggcagatcacctgaggtcgggagttcgagaccagcctgaccaacatggagaaaccctgtctctactaaaaatacaaaattagccaggcatggtggcgtatgcctggaaatcccagctactcaggaggctgaggcaggagaattgcttgaacccgggaggcagaggttgcagtgagccaagatcacgccattgcactccagcctgggcaacagagcaagattccatctcaaaagaaaaaaaaaatcacctctcatctttctgtttttaggagatcaatgatctgttggttaaggaaaagattatgcaacttgtccagcagagatcacaaatccaaacccttcagaagaaggtagtaaacttggagactgctctgagttacatgaccaaagagtttgagagtgaagttttaaaactgcagcaacacgcaatgatagagaaccaagcaggtcaggtagaaattgacaagctgcagcaccttcttcagatgaaggacagggaaatgaatcgtgtgaagaagctggccaagaacatactggatgagagaacagaagtggaaagattctttttagatgctctgcaccaagtgaagcaacagatcctaattagcaggaagcattataagcagatagcacaagctgctttcaatttaaaaatgagagcagcatgtacaggaagaacagaatatcccaaaatcagaacatttgatggcagagagcacagcaccaatagtgtgaatcaggatcttctggaggccgaaaaatggacacatattgaaggaaatgtggatattggagatttgacctgggagcagaaggaaaaagtattgcgattgctctttgcaaaaatgaatggctgtccttctaggaaatacaaccagagttctaggcctccagttccagactatgttgtttctgacagtggggaaacaaaggaatttgggtaagagctctcttgcttaagtaataaacatgagcccaacacgatggttcttgtgggcatcttgaatgtgctaattgaaagtaatatgacaagtctgttattctaaaccaggtttcatgtgtgtagagttgttgacggttctgttattttgtcattattgcagggatgaaagtaagcttcaagataaaatcttcatcacccagcaaattgcaatatcagactcttctggtgaagtggtgctacccactattccaaaagaacctcaggagtctgacacagtaaggagtctgtatctaatcaaacaatgtatattgttgtcacccttccccatgtcgcttcttgctaaatcacggttattttctctactagttgagagacttcagggatcagtggaatgagtaataaatagcattagtagattacataaatttttaaagcaatatccgtacaaatgcatattatactaatgcaaatgcaaatgtgtgcctctttttgtgtagaaacctataggttgccttttgaagtaaacagcctagccaaaatgtgtactatcttttacgtaagagtaaacatagtgaccttgtgactcttagctttccatcacaggtgggaagtcagagtcattacaacctagaggacaaaggcttataaggagatatgaaatgatttttttaagccaagtttttctctttaagagtttttaatttataatttgttattcataattagtacaatgtagaatctgagaaatttcaaatgaagccacattagaacaaaaagaaaatactgactttttagccgcgatcacatgaatataactgatgagtttttttcatctaagaaataagaaactctgagcagcaaatagttggccagatgagttgtttctaattagagcatcacagttctgattagtgtgtttttttagaagtgatttcccttaaatataaggaaaatgttaggaatctctgtgactacatttaattccacttggaatatagacaataatgaccttttatttaacccagcctatagttgttggattggattaaatatcactaccagggccaggtgcggtggttcacgcctgcaatcccagcactttgggaggccgaggtgggcggatcattaggtcaggagattgagaccatcctggctaacatggtgaaaccctgtctctactaaaagtacaaaaaattatccgggtgtgggggcatgcacctgtaatcccagctactcgggagactgaggcaggagaattacttgaacccaggaggtggaggttgcagtgagc

SEQ ID NO: 284456 - DNA, 2652 bp, Homo sapiens
  misc_feature (168)..(168): n is a, c, g, or t
  misc_feature (269)..(269): n is a, c, g, or t
aaaaattagccaggcatggtggcatgcacctgtaatcccagctattcaggggtctgaggcaggagaatcacttgaacccagggggcggaggttgcagttagccgaggtcgcgtcactgcactccagcctgggcgacagagcgagactccatctcaaaaaaaaaaaaanccaccaacaaaaaaaatcactaccagttgccagctgtgataagagctaaaacaaggggtactgtagtctcaaattataaatttctattgcctcatattacnaaagttccagtcaccttaagtgattgaaggttttgacattttatccagccaggtggtagtaataagcctcaaatccacagggtacacaacattttcaaggtctttttttttttttatcatacttaattcatgaataacccccatagtgtaggttagttagcactatcaaagtgactggtaaggacgcaggaaaataaaaagaggattcaattggattggtactgcaaaaagaatccattctgttcagcacatgaatttctgttctgaccttaagtttagatatatcaaagaaacaaaaagcatagaggcggctgggggtggtggctcacacctgtaatcccagcaccttgggaggccaaggcaggcagatcacctgaggtcgggagttcgagaccagcctgaccaacatggagaaaccctgtctctactaaaaatacaaaattagccaggcatggtggcgtatgcctggaaatcccagctactcaggaggctgaggcaggagaattgcttgaacccgggaggcagaggttgcagtgagccaagatcacgccattgcactccagcctgggcaacagagcaagattccatctcaaaagaaaaaaaaaatcacctctcatctttctgtttttaggagatcaatgatctgttggttaaggaaaagattatgcaacttgtccagcagagatcacaaatccaaacccttcagaagaaggtagtaaacttggagactgctctgagttacatgaccaaagagtttgagagtgaagttttaaaactgcagcaacacgcaatgatagagaaccaagcaggtcaggtagaaattgacaagctgcagcaccttcttcagatgaaggacagggaaatgaatcgtgtgaagaagctggccaagaacatactggatgagagaacagaagtggaaagattctttttagatgctctgcaccaagtgaagcaacagatcctaattagcaggaagcattataagcagatagcacaagctgctttcaatttaaaaatgagagcagcatgtacaggaagaacagaatatcccaaaatcagaacatttgatggcagagagcacagcaccaatagtgtgaatcaggatcttctggaggccgaaaaatggacacatattgaaggaaatgtggatattggagatttgacctgggagcagaaggaaaaagtattgcgattgctctttgcaaaaatgaatggctgtccttctaggaaatacaaccagagttctaggcctccagttccagactatgttgtttctgacagtggggaaacaaaggaatttgggtaagagctctcttgcttaagtaataaacatgagcccaacacgatggttcttgtgggcatcttgaatgtgctaattgaaagtaatatgacaagtctgttattctaaaccaggtttcatgtgtgtagagttgttgacggttctgttattttgtcattattgcagggatgaaagtaagcttcaagataaaatcttcatcacccagcaaattgcaatatcagactcttctggtgaagtggtgctacccactattccaaaagaacctcaggagtctgacacagtaaggagtctgtatctaatcaaacaatgtatattgttgtcacccttccccatgtcgcttcttgctaaatcacggttattttctctactagttgagagacttcagggatcagtggaatgagtaataaatagcattagtagattacataaatttttaaagcaatatccgtacaaatgcatattatactaatgcaaatgcaaatgtgtgcctctttttgtgtagaaacctataggttgccttttgaagtaaacagcctagccaaaatgtgtactatcttttacgtaagagtaaacatagtgaccttgtgactcttagctttccatcacaggtgggaagtcagagtcattacaacctagaggacaaaggcttataaggagatatgaaatgatttttttaagccaagtttttctctttaagagtttttaatttataatttgttattcataattagtacaatgtagaatctgagaaatttcaaatgaagccacattagaacaaaaagaaaatactgactttttagccgcgatcacatgaatataactgatgagtttttttcatctaagaaataagaaactctgagcagcaaatagttggccagatgagttgtttctaattagagcatcacagttctgattagtgtgtttttttagaaacaactcatctagccaaccgtggactagtactagtccacggttggctccagggaagaagctgttggcggatgtaccctatgagaaagcttggcagaagatgatcttagagttgtgttctaaggtggcatccttgggtaggaagcgttatta

SEQ ID NO: 284457 - DNA, 822 bp, Homo sapiens
gaatccgttctctctgggatgtgtagctttggaaatctgtctttgttgctctgggagaggggactcctggaatgtgtctgtgaataaagactagccgaagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaactacaaaaaaaaaaaaaaaaaaaaaaaaaaaaaaaaaaaaagaaaaaaaaaaaaaaaaggggggggggggaaaaatatccccggggggcccattatgatggctgcccagtttttagtcaaaggggccccaagagggggctgataataagcgggcgcggggcagctaaacaacgcggggcgggaaaaaggccaacgcatcttgtggagagacccaatctgggggggacaatggggaaacccaggagttatgaggcgaggcataaaactcggggttgtggaaccccacacattgcgggcgaagtcgcgagaatgaattatg

SEQ ID NO: 284458 - DNA, 902 bp, Homo sapiens
gaatccgttctctctgggatgtgtagctttggaaatctgtctttgttgctctgggagaggggactcctggaatgtgtctgtgaataaagactagccgaagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaatttacatgtgtg

SEQ ID NO: 284459 - DNA, 1643 bp, Homo sapiens
gaatccgttctctctgggatgtgtagctttggaaatctgtctttgttgctctgggagaggggactcctggaatgtgtctgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacaggtgacccgataggaagcacaactgcttctgttggagtgcggttacctggagaccgcagtctgaagggactcccggcagagatgtcgttacggtgtcctgcctgtctggatgcttaggagcgcgactcaaaactacacccctgacgaccctggaggtgcttggggcgggaggttgaagggggcaccgaggttacaaaagccgtgactgtcttacagaaccgaaagatggatctttgaatccctagagtgcaggggagacattgcctgttaaagatgtttaccacttctacatttagtaatagaaatacagttattaggttttaacgagtgcactttgaaggtcctttgttttcttcactgtttttactcctgtttttagggttcttttagggaagcagagaaggttcctaaacacatcttcttttcatcttcattctaggaaaatagagttagtggctttttcacatctttccagtccaagaacttttggatactgtactgtgaaacattaaatcttgctgatccgtgctggccatgttttcttgattgctccagagtagcaagtaacctcatatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaatttacatgtgtg

SEQ ID NO: 284460 - DNA, 1225 bp, Homo sapiens
gaatccgttctctctgggatgtgtagctttggaaatctgtctttgttgctctgggagaggggactcctggaatgtgtctgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacaggtgacccgataggaagcacaactgcttctgttggagtgcggttacctggagaccgcagtctgaagggactcccggcagagatgtcgttacggtgtcctgcctgtctggatgcttaggagcgcgactcaaaactacacccctgacgaccctggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaatttacatgtgtg

SEQ ID NO: 284461 - DNA, 1159 bp, Homo sapiens
gagatactttggaggatgaaagttcaacgttggtcacttgaatgaagaagttgattatgacaatgtgatggctaacctccaagtttagtcctgcagagatagagacatcaaagagctattcaagcagcagaagagaaaggacaccagcccagacgtagagaaatcgtgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaatttacatgtgtg

SEQ ID NO: 284462 - DNA, 951 bp, Homo sapiens
gaatccgttctctctgggatgtgtagctttggaaatctgtctttgttgctctgggagaggggactcctggaatgtgtctgtgaataaagactagccgaaggtgcgaagtgactagacgggagcaaaggaggaaaactagggaatgggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaatttacatgtgtg

SEQ ID NO: 284463 - DNA, 1092 bp, Homo sapiens
gagatactttggaggatgaaagttcaacgttggtcacttgaatgaagaagttgattatgacaatgtgatggctaacctccaagtttagtcctgcagagatagagacatcaaagagctattcaagcagcagaagagaaaggacaccagcccagacgtagagaaatcgtgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacagatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaatttacatgtgtg

SEQ ID NO: 284464 - DNA, 897 bp, Homo sapiens
gaatccgttctctctgggatgtgtagctttggaaatctgtctttgttgctctgggagaggggactcctggaatgtgtctgtgaataaagactagccgaaggtgcgaagtgactagacgggagcaaaggaggaaaactagggaatgggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccattttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaatttacatgtgtg

SEQ ID NO: 284465 - DNA, 680 bp, Homo sapiens
gaatccgttctctctgggatgtgtagctttggaaatctgtctttgttgctctgggagaggggactcctggaatgtgtctgtgaataaagactagccgaagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaatttacatgtgtg

SEQ ID NO: 284466 - DNA, 817 bp, Homo sapiens
gagatactttggaggatgaaagttcaacgttggtcacttgaatgaagaagttgattatgacaatgtgatggctaacctccaagtttagtcctgcagagatagagacatcaaagagctattcaagcagcagaagagaaaggacaccagcccagacgtagagaaatcgtgtgaataaagactagccgaaggtgcgaagtgactagacgggagcaaaggaggaaaactagggaatgggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataattccctttgtggaaatttacatgtgtg

SEQ ID NO: 284467 - DNA, 8228 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaatgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggtgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacatcatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagtggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgctaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtccttcgggacacacttaaaccttccaagtagcacagaagccccctccacgtcagagccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccaggcagaggcgcccccctccatcctcccccatcccgggggccacggcaggggggccgcacagcgcggctgggaccgattcggtgacggcccaaggaagctgggcgcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaggctc

SEQ ID NO: 284468 - DNA, 8288 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaatgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggtgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacatcatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagtggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgctaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtccttcgggacacacttaaaccttccaagtagcacagaagccccctccacgtcagagccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccaggcagaggcgcccccctccatcctcccccatcccgggggccacggcaggggggccgcacagcgcggctgggaccgattcggtgacggcccaaggaagctgggcgcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaggctc

SEQ ID NO: 284469 - DNA, 7742 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaatgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggtgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacatcatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagtggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgctaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtccttcgggacacacttaaaccttccaagtagcacagaagccccctccacgtcagagccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccaggcagaggcgcccccctccatcctcccccatcccgggggccacggcaggggggccgcacagcgcggctgggaccgattcggtgacggcccaaggaagctgggcgcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaggctc

SEQ ID NO: 284470 - DNA, 8153 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaatgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggtgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacatcatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagtggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgctaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtccttcgggacacacttaaaccttccaagtagcacagaagccccctccacgtcagagccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccaggcagaggcgcccccctccatcctcccccatcccgggggccacggcaggggggccgcacagcgcggctgggaccgattcggtgacggcccaaggaagctgggcgcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaggctc

SEQ ID NO: 284471 - DNA, 458 bp, Homo sapiens
gatgagcagggcaacattgtcaccaagaagatcattcgcaaggtggttcgacagatagacttgtccagcgccgatgccgcccaggagcacgaggaggtgctttgtgctaaagcacatccaccaggagctggacaaggagctgggggagagcgagggcctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaggctc

SEQ ID NO: 284472 - DNA, 913 bp, Homo sapiens
tgtcacccgggccactcagggcagagcctggctgctgggcagaagggcacttgggccgggctgcttcagccgagagggccattcggtgtcctgcccacagagagagaaacagtgagagaccaagagagcaaaccagagagggatagaaaacaagcgcaggagagcctgcgaacgcaaaagtgaatgagggctttttgtggctggggatgggttttggttttggggttttttttttaaattgttttgacttcgtacaatgattttgggaattacaacaatcagtcttcaaattttggacccatgaagggaggaaatttggaggcagaagctctggcccctatggcggtggaggccaatactttgcaaaaccacgaaaccaaggtggctatggcggttccagcagcagcagtagctatggcagtggcagaaagattttaattaggaaacaaagcttagcaggagaggaggagccagagaagtgacagggaagctacaggttacaaccgatttggtgaactcaggcaagcacagtggtggcgggctagctgctacaaagaagacctgttttagacaattctcctgtgttttggcgcaaaaactcgggggcgttttgtgactactgtttaccggtatttagttctgtctggggaggtgttaggcttcaccaggggtgtcttgtagttttttttttggcccctggtgggttggtttgttccgcttgttgggcgcggaaaaggcttttaaccggggtaggggcctccttgcccttgtgattcccagggtggagcctccggggcggcgtgggttcccgccgggggccggtcttgccctgtgtcttgtgttggcgcccccggccccccgggtggtgcgggccctcttttgcgcaagggtgttggtgcaaccgccgtcgtgc

SEQ ID NO: 284473 - DNA, 6807 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaatgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggtgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacatcatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagtggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgctaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaacca

SEQ ID NO: 284474 - DNA, 1812 bp, Homo sapiens
tgtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaacca

SEQ ID NO: 284475 - DNA, 1752 bp, Homo sapiens
tgtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaacca

SEQ ID NO: 284476 - DNA, 1746 bp, Homo sapiens
tgtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaacca

SEQ ID NO: 284477 - DNA, 1569 bp, Homo sapiens
tgtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaacca

SEQ ID NO: 284478 - DNA, 1677 bp, Homo sapiens
tgtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaacca

SEQ ID NO: 284479 - DNA, 4205 bp, Homo sapiens
agatggtcagatggggccctttcctgtggtggcgcagtccttggatgcagcccaggacagcagcagtgagaaaccagtgggtccttgaccagcccactgtcttcaactcttggcctagggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacatcatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagtggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgctaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaacca

SEQ ID NO: 284480 - DNA, 1611 bp, Homo sapiens
tgtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaacca

SEQ ID NO: 284481 - DNA, 1209 bp, Homo sapiens
gggctgcaagtgcagcaccctcagcacatcgccctgcctggggagactgcttttcctgagtcagattcggcctgagctgccagcacaaaactctgtgtgtggggtttttgctggacgttgcacttttgcattctaagtgactccttctctctttgtgtctcccaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacacacaccactcgcctccactgaatctacacacagattttactgtgacttctgaagctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaacca

SEQ ID NO: 284482 - DNA, 3537 bp, Homo sapiens
agatggtcagatggggccctttcctgtggtggcgcagtccttggatgcagcccaggacagcagcagtgagaaaccagtgggtccttgaccagcccactgtcttcaactcttggcctagggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacatcatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagtggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgctaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggtaacgctgcccttctcatcccctctgcatggcctggtcttcagtggagtggctgctccctgtctcaccctatcccctcccagccaccccagcatgatgtgggacaaacaacttgttgttgtgtctcgaggcagagattctcacttcccaaccctgctaacagttggctctgaaccccagcttcctcatcaaggaaacagagttaataatatccacttatcagggaccgcacggttttgtaagaatgccttttgggccgggcacagtggctcatgtctgtaatcccagcattttgtgaggtcgaggcaaaaggattgctttaggccaggagttcaagaccagcctgggcaacagagcaagaccccatcacaaaaaa

SEQ ID NO: 284483 - DNA, 2030 bp, Homo sapiens
agatggtcagatggggccctttcctgtggtggcgcagtccttggatgcagcccaggacagcagcagtgagaaaccagtgggtccttgaccagcccactgtcttcaactcttggcctagggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacatcatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagtggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgctaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtcctgcagtgaggagtagccattcatctgggagggtgacagcgagtagtcgcggtcggtgtgccgcctgtctggcttcaagttgcggctctgtcggccggaaccctccag

SEQ ID NO: 284484 - DNA, 418 bp, Homo sapiens
cagctccatcgcatattaactgggtgatcttgggcaaggaactttgtctctctatgcctcagtttacgtattgatgaaatgggagtaatacagcacccacctcttaggttgccgtgaacattaaatagggcctcacaggtgatggggtgacgtgggcttgccgttattacgactgtgattaataacgcatgtgcgcttcttcagcttcccttcactcccactcctcccatgtgttactctttgtgttaagtccctgaagaaacggactgattgtttaccaggactggggtcagccttccacacccctgcagcataggagctcagatcactttctctgggaaggtggggagagtccaaaacccaaagcaccctttcttcttctgcagggaagtggagccgaagataggagaaggacccc

SEQ ID NO: 284485 - DNA, 331 bp, Homo sapiens
atcattcgcaaggtggttcgacagatagacttgtccagcgccgatgccgcccaggagcacgaggaggtgactgtagaggggcccctggaggatcccagtgagctggaggtcgatattgattactttatgaaacactccaaggtactgaggcgcccgcggccctgggggacccagcgccatcactgctgccttgctctgccgggccgtctgcatgacacctccctccactcacctctttatgagctctctctccagtctctcttctccctggtgggcagtgtgtctgcacctccgtgtggcctcctttcgatcttctgcctgtgttctgccc

SEQ ID NO: 284486 - DNA, 179 bp, Homo sapiens
acttgtgacaccccctcgactccctggtgacgctcctcccagatcgctctacatgacattcaggacacacacacacacacacacacacacaccactcgcctccactgaatctacacacagattttactgtgacttctgaagctgtatagactctgctgtggataaattggaatttttta

SEQ ID NO: 284487 - DNA, 1251 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctc

SEQ ID NO: 284488 - DNA, 1387 bp, Homo sapiens
ccaaacaattcaactgtctaaacctttcatctgtaaaatggggataacataattatttacctaatgatattggacagaaaccacccattttgagcatattatttccagctctaggaactgagtctattcttgcataagtatggtcaatcatgtttgctacccggaataacttaattcaaaggtagctaaacagtgatctctgtttaacagtttctgggaaaatggaggcagtgatttgctgaaggccacacagcaaatatttctgtagctatgttctttccactatattccactatgctaggctttacccctcttccccagcagcacaagttaaatgacttcgtagcatttttcaaattcaggcaaaggccaaggccaaacagctcgtttagttggttgtgtaaaggtttgaaggcacttagtagatttagtttgaaaacctcactgaagccaaaataggtgtgggggttgcttacctaccctttgtctatggaacctccctgttctcaaactgctcttcttcccttttccctccacaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284489 - DNA, 678 bp, Homo sapiens
aagcacgttaaatggtgtggattgaagttacagaaagaaaacttaaaaccatttacaaatcatcatcaactataaatagacacggccttgatgtcaagaggacatttatagtttttcaaagatgatactgcttttgtttttagattttcgtagctctctgttgacaggcctagcaaggtctcagaatccatttctcatattatggtcagttatttcataaggagagtgttaaaaaaaaattaggaactagaatgttatttgctacttgtaggccactggaattgtaatgactgtcaacttatttaaagtgggtaatctctttttctgatttctgttccctgtctccaaacaggtctgataactttggaggaactacatcaacaggtgttgaagggaaggggcaagttcgcccaggatgtcagtcagtaggtcttgtcttccaatcccttggagtacagaaagaggtctttaaaattcagatggaactcttttctccctattcctcatgtctaggctagcttagaaatctgtatgatctccatatcatacaggaaaaaaaaaaacaaaaaacaaacaaaaaataagagatagggtctcacttttgcccgggctggagtacagtggcatgatcacagcttactgctaccaagatcattgcttactgcagcctcaaactct

SEQ ID NO: 284490 - DNA, 509 bp, Homo sapiens
  misc_feature (9)..(9): n is a, c, g, or t
  misc_feature (31)..(31): n is a, c, g, or t
cttaatggntgactcccagcttttcccccantaggtaacggaatcggctgaatccagattgcaaccgcttccaataacacggtttttgggaaaaccacttatcttccaagccacgtaggtcaagatatccactggatttgaaacaataagcaacttgcagttcgggctgtattttacaacattaggaatgagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggtttatttgccacctccgcctcctccctgcctgctgctgtgtgcccttccacatgcagtcaggggagggcttctctggcctcctcagct

SEQ ID NO: 284491 - DNA, 2816 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagccagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284492 - DNA, 1797 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcaaaaaaaaaaaaaaaaaaaaaaaaacaaaaaaaaaaaaaaaaaaaaaaaaagaaaaaaaaaaaaaaaaaaaaaaaaaaaaaaaaaaaagaaaaaaaaaaaaaaaaaaagggggggggatcatttatatatactcactcccagcagggacacctcgacgctgcaagccgtcacaatagtccatttgtctagcagcagatagagcgcggcccgtcatgtagacggtctacgtattattattataaaccaacatcggccccgcgcttccaccttgtcaactacacaagcaccgggtccagagtgagcagaaactaatcacccgtggctgccacaccactccttacgtcgcggcggaacacgacaccatcttccttgccatgctgcgggtaggaccctaacccaggcccgcgcgacacccacaccgacgagtagcaaaagagacgcaaggcccgtccggcaaggggactatattctcaatcacttgctcggcgcagctaatgtatgggctggt

SEQ ID NO: 284493 - DNA, 966 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaaccaagatgcggccgccaccgcgtggagtatgagg

SEQ ID NO: 284494 - DNA, 2959 bp, Homo sapiens
gccccactgggtttctatttaggaatctgtggtaaaagtccgttttccagcctgttaaaaaaagacatggacccaagggttgggtattttatacaggaaaaaaggtttagggctgggcacatgggctcatgcctaaatcccagcactttgggaggccgagggggggggatcacttgctggtcttgaactcttggtctcgagcgatccacctagctcgatgtcccaaagtgttggaattacaggcgtgagccactgcgcccggccagaaatgacttttagattgcctgccctctggaaccgtctgaccctgttcttcagcaggagttaccgtgagtccgattgtttcctgagtagcagatggagcagaagaacttcatgccatgcagggaagacttcccatatgatagatgttttaatgcaggtttgaaagaaaagaagggatgtaaattaatcaataaccgagattttgtttttctgtcttgtagctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagccagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284495 - DNA, 2895 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggagtctacaggcctctaaggacttgagagacatcttagctgtttcatgcagttgaatccatggcaagtctccatggccaagggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagccagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284496 - DNA, 2873 bp, Homo sapiens
tgaggatgactcgcccatgggcgagtcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtgagggtggctaggtcctgtgaactggactctggacttctctgagagggagaaaaccgtgattatcgtttccatcctgcagtctacaggcctctaaggacttgagagacatcttagctgtttcatgcagttgaatccatggcaagtctccatggccaagggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagccagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284497 - DNA, 2855 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcagtaggtcttgtcttccaatcccttggagtacagaaagagagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagccagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284498 - DNA, 2338 bp, Homo sapiens
accgagccgcctactactactaaattcgcggcccgtcgaccaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagccagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284499 - DNA, 2496 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagccagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284500 - DNA, 2615 bp, Homo sapiens
ccaaacaattcaactgtctaaacctttcatctgtaaaatggggataacataattatttacctaatgatattggacagaaaccacccattttgagcatattatttccagctctaggaactgagtctattcttgcataagtatggtcaatcatgtttgctacccggaataacttaattcaaaggtagctaaacagtgatctctgtttaacagtttctgggaaaatggaggcagtgatttgctgaaggccacacagcaaatatttctgtagctatgttctttccactatattccactatgctaggctttacccctcttccccagcagcacaagttaaatgacttcgtagcatttttcaaattcaggcaaaggccaaggccaaacagctcgtttagttggttgtgtaaaggtttgaaggcacttagtagatttagtttgaaaacctcactgaagccaaaataggtgtgggggttgcttacctaccctttgtctatggaacctccctgttctcaaactgctcttcttcccttttccctccagaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagccagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284501 - DNA, 1849 bp, Homo sapiens
cccacagagacaacacagcaagaaacacacgcgagctattatgaaaaggcgtcggggttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaactagctggtcctaatggaccagtaaataatattcactttcagtctcttctggcttcctctgtagaggctctaggttatgacagagttagctgtgagtatgaaggaaatagaagtcaatgtccaatcgtggctaaattggaggaaagaaaacaatggaatctgaggggaatcaaacaatagttagggaatgttctattttcttaaattccctactagctttctcaccctcctgtagtgattgccaggtccctctagcctcagtagtgggaaagggagtcatttactgaacacctaccctgtgccattttacatacagctcacttaaatttcaccaagtaggcagccttcaacatcacaggtgattcaatcaaagtaatttgccaggggccgccagcttcagccgagctaaagctggtgcctaggcctattaacccgagcccatgccttcatgtatcactgcatagtacagaatggcagcacatactgtgtgtagacatttttctacacacgtggtcagccaagagtaaaagcctctgcatcagaaagcaagaatctcctatagccagtagaagtggtgatgagggaagaggccagagttgtttaaggctcccaaagtccttatggtctaaaggctaagatcctaaaagtgctagtttagtactggaaatctgaaaactcaatggtttttccatactgagacccttcctttagcaggatatagcctgggcccatctcttcctctgcctatccttgtaggacatgctcactccaagctctggaataggtctgtctttggaaaccactcaaactaagatgtcactgactgccagagcatggaccccatttccaatgagaaaacttgtcctgctctccccacccagccctgcccttccaccatgttatgcaagtcttcggtttccagacaattcatggcactttccttctccctaacagttccaggcctgggtgaggtgtggttgacaagatgatcccattcgtcctttacacaagccctcccacacccacaggcacttcctccttctgccaaaacaaactttattgcaccaaaaaggaaaacaaaaaaaacaaaaaaacttcatttatatacagtcagatataaagacatctctttgactcctgtgcatatatttcctcaactcaagattagggcataaaagtcaggctgctatgccagacatgctctgccctatggcagggccaaggagaggattgtcacttgaaagtgggaacacttaaatggatgacagacaacactggacccacagaccaagagcattcttctaagccctggagtagctcgaggaatggaagagggaaattggaagcagggtcccttttcgatcttcatgtgaagagacccagcctcttcaagggtatccaagataaacttccgttccccaagcccaccaatccctgtccagttcctttgcttcctgccctcccaaataggacattctcctttgtgcccagcccccctttgcacagatcctccaaggggagtcccatgatccacaaggcagagaccttcatagcagagggca

SEQ ID NO: 284502 - DNA, 773 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcagtaggtcttgtcttccaatcccttggagtacagaaagaggtctttaaaattcagatggaactcttttctccctattcctcatgtctaggctagcttagaaatctgtatgatctccatatcatacaggaaaaaaaaaaacaaaaaacaaacaaaaaataagagatagggtctcacttttgcccgggctggagtacagtggcatgatcacagcttactgctaccaagatcattgcttactgcagcctcaaactct

SEQ ID NO: 284503 - DNA, 916 bp, Homo sapiens
gccccactgggtttctatttaggaatctgtggtaaaagtccgttttccagcctgttaaaaaaagacatggacccaagggttgggtattttatacaggaaaaaaggtttagggctgggcacatgggctcatgcctaaatcccagcactttgggaggccgagggggggggatcacttgctggtcttgaactcttggtctcgagcgatccacctagctcgatgtcccaaagtgttggaattacaggcgtgagccactgcgcccggccagaaatgacttttagattgcctgccctctggaaccgtctgaccctgttcttcagcaggagttaccgtgagtccgattgtttcctgagtagcagatggagcagaagaacttcatgccatgcagggaagacttcccatatgatagatgttttaatgcaggtttgaaagaaaagaagggatgtaaattaatcaataaccgagattttgtttttctgtcttgtagctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcagtaggtcttgtcttccaatcccttggagtacagaaagaggtctttaaaattcagatggaactcttttctccctattcctcatgtctaggctagcttagaaatctgtatgatctccatatcatacaggaaaaaaaaaaacaaaaaacaaacaaaaaataagagatagggtctcacttttgcccgggctggagtacagtggcatgatcacagcttactgctaccaagatcattgcttactgcagcctcaaactct

SEQ ID NO: 284504 - DNA, 748 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtgagggtggctaggtcctgtgaactggactctggacttctctgagagggagaaaaccgtgattatcgtttccatcctgcagtctacaggcctctaaggacttgagagacatcttagctgtttcatgcagttgaatccatggcaagtctccatggccaagggtaaatagaattacctgaacgattgtctctgttctccgatctttggccaggaaggtctagtccctagtcagtacaggagtgattttctcattagtaactatagtcctgcactgtctctccgacgtatgggatgccaactg

SEQ ID NO: 284505 - DNA, 934 bp, Homo sapiens
ggcggctcgggcttccgccttggggagccggcggcggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtgagggtggctaggtcctgtgaactggactctggacttctctgagagggagaaaaccgtgattatcgtttccatcctgcagtctacaggcctctaaggacttgagagacatcttagctgtttcatgcagttgaatccatggcaagtctccatggccaagggtctgataactttggaggaactacatcaacaggtgttgaagggaaggggcaagttcgcccaggatgtcagtcagtaggtcttgtcttccaatcccttggagtacagaaagaggtctttaaaattcagatggaactcttttctccctattcctcatgtctaggctagcttagaaatctgtatgatctccatatcatacaggaaaaaaaaaaacaaaaaacaaacaaaaaataagagatagggtctcacttttgcccgggctggagtacagtggcatgatcacagcttactgctaccaagatcattgcttactgcagcctcaaactct

SEQ ID NO: 284506 - DNA, 6070 bp, Homo sapiens
gggcgggcgggaggcgcggaggcagcggaggctgctcggccgcaaggaggcaggcgggaggccaggggtgcagaattggggcggggggctcccttcacccccgcagccctccgcccgggtccgtgtggccaggcctcacgtgcccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaagttttcatatgagtccaacaagcaatgaagacctcaggaaaatcccggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccatatgaaccatccaggaaagctggcaaattctctaacagttaataaagccaattgtattgtattgataattggacaaagagagagaaagaaagaaggaaggaaggaaaaacttgttactgaaagagactacactatcaggtttcattacatattctcctttattgtgaagagtagttttacctgtaaatattagcagggactatcaagagtgacctttgaagcaagctaaatcatttaaatgtttaaattgaaaatgggccagattctcaatgaataagtggttccttaggactcactcaggtgctggtactgacccactaatctgccataggcccagaaatatcttcagaagtacgtgagttgttcctcaggaatagatttttcataaagcagaattgatcctgtggctggtttctcagaaatcagtttgtagaaatatttagcttcaggaatactgctcgttataaacactactaaaaaaacagtttatattttatatacacatatgtacatgaatatatatatattcatgtatcttgtatataaaatataggcatatacctcatatatacatgtgtttttagaacatttagaaacaattgattgcctctaaagttaggctaccaatttcttgatttgaaaatgtgtgtgctctattgatgcaagacaagtcatccttcctactgtcatggtttgttatagagaagctgcttcaaatcactcttgactacatggaccttggtttcaaagtgagctgctatatattattctagcatcaaagtttttctctttccccaaaagtgatgatctcaagtccttttttaaagaatgacaaattttaggagacttcattaacttcataacagcatgaatttatttgaattaattaacatttgagtttgtttaaggtataagcagaagataagctaatatagcttgttttgttgaaattctgcatgcctttaaatcactagcaaagcaaatattataaagttatatctgaaaataattgtgggaagtatgtgattgcctggtgtgtctgataacccaaagcagcgggcagattccaggaatgaagaattaggcttggtttcaggttacataaataatagagcagatggttgcctttgggtcttgaaccaaaataagacttactaaaggaagagtgagtttttagaagagaactttacgagcgtgacattatgcattactccacatccaccctttaagaattgatttattacaaaattatgttctattttaaagtccactcccccaaaatactgatttcttccatggattatttttatatgatttgtacaaattttttctgaaatttaagttgacaagcaatgttataaaaatattgctaatcttctgcttatttttcagcctttaaagtctgaaatactataaaacactgagagtatctatgtctttctgaatttaaaatgaaaattcatgtccatatggagacttacatattccccaatctttccatgaattgcatttttttctaatacttatctctgttaagactccattgaaagttaaacaaaaagccgatataatagtttgggttttttttttttgcttattttagtattttgaatcagagaatacttggccaagctcgtatttgtaaactaaaaccccttgttatttgtatcttctgcatttcagttttactgtaagaacatacattttgaaattatgaacatttttttcataaaaattaaatgctttaagaaatggagaaggaaaaatagcttttatcaatttttttctcctcaagattctgtaataaacctcaaagtctggtgtagaatggtattttcccgtttgaggtcttggtagttttttttttttttttaaacatggtgccacttttaattaactaaatgttacaaaattctcagcatttgtttttgtctggtagtattattgagtcttttcatacacttcttaaaatgtgaaaatctatgttttcagtattatgacagtatctgcagatactataataatatgctttggccaaatttgctgtttatagagtgaaccaagatgtcagttttgtattggggatatgttttacataaatagaactcatttaaaagtatggttcaagtactgctcttctttttatggggaaattgatttttaaggagcgattcttttcctatataaaagctattgaggcttagctttattcatacatgagtgatttggttataactcaatcaaaatttttatctttaaatctgagacaagtattatatttaaaactagatctattaatacattcatcactgcctgaaaatttgctgttctaatgtttgtgaattttcactcattacctagagtaaacttattgcatattttcataatcagtcaaaataataaaactaaaaacaaaaagtaaaaattagttcccaagtaaatatatcagtgtttcctgtgtttgggcagaagtgcaaagtagttttaatttctcacgttgtagaaaaagaggccaaaaaggtcaccttagtttatttttccaaaacataactttaggtattctaatgtattttgttagttgcttagaaatggaaataaaatatatgtgcttattaaataatgcacagtacactagattatagagtttatttttgcttttatgctttaaagaatgcatgcccaaaacactactaccaacaagaggattttttaaaatcacagaattgatatttatctcaagactatcttaagctaatgtacttctgttacataattaaactatttctgctattatttttaaagcagtattattttataaccaattctaaaattcagctttaaaaatattgaacataccttcctaccacttacgcttcaagtttcatttattgaataccagggtcatatcttagaattgtatataaaacaacatgtaacccattcatgaaaaacgtttttaagtattgctttttgctgctatgttctgcattgagcctagttttgccattgtcccctgaatgtagtattatctatagattatacataactacatctattgcttttggtggtaaatcaagatttagttgtaattttccagctgtgaaaatgttgccttgtatttaaaagggtttcatgaatggaaacctaagtaaaactaagctcattagtgacagacttgttttcttcttgttattcctccagcaactccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaacttaaaaaaaaaaa

SEQ ID NO: 284507 - DNA, 6016 bp, Homo sapiens
gggcgggcgggaggcgcggaggcagcggaggctgctcggccgcaaggaggcaggcgggaggccaggggtgcagaattggggcggggggctcccttcacccccgcagccctccgcccgggtccgtgtggccaggcctcacgtgcccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaatttatctgggtcccatatgtcttctgagaaactgaaggctggcaccataggtcaaacacatcttctcggacaccagttagattcctttggaacagttccagaaagtggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaagttttcatatgagtccaacaagcaatgaagacctcaggaaaatcccggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccatatgaaccatccaggaaagctggcaaattctctaacagttaataaagccaattgtattgtattgataattggacaaagagagagaaagaaagaaggaaggaaggaaaaacttgttactgaaagagactacactatcaggtttcattacatattctcctttattgtgaagagtagttttacctgtaaatattagcagggactatcaagagtgacctttgaagcaagctaaatcatttaaatgtttaaattgaaaatgggccagattctcaatgaataagtggttccttaggactcactcaggtgctggtactgacccactaatctgccataggcccagaaatatcttcagaagtacgtgagttgttcctcaggaatagatttttcataaagcagaattgatcctgtggctggtttctcagaaatcagtttgtagaaatatttagcttcaggaatactgctcgttataaacactactaaaaaaacagtttatattttatatacacatatgtacatgaatatatatatattcatgtatcttgtatataaaatataggcatatacctcatatatacatgtgtttttagaacatttagaaacaattgattgcctctaaagttaggctaccaatttcttgatttgaaaatgtgtgtgctctattgatgcaagacaagtcatccttcctactgtcatggtttgttatagagaagctgcttcaaatcactcttgactacatggaccttggtttcaaagtgagctgctatatattattctagcatcaaagtttttctctttccccaaaagtgatgatctcaagtccttttttaaagaatgacaaattttaggagacttcattaacttcataacagcatgaatttatttgaattaattaacatttgagtttgtttaaggtataagcagaagataagctaatatagcttgttttgttgaaattctgcatgcctttaaatcactagcaaagcaaatattataaagttatatctgaaaataattgtgggaagtatgtgattgcctggtgtgtctgataacccaaagcagcgggcagattccaggaatgaagaattaggcttggtttcaggttacataaataatagagcagatggttgcctttgggtcttgaaccaaaataagacttactaaaggaagagtgagtttttagaagagaactttacgagcgtgacattatgcattactccacatccaccctttaagaattgatttattacaaaattatgttctattttaaagtccactcccccaaaatactgatttcttccatggattatttttatatgatttgtacaaattttttctgaaatttaagttgacaagcaatgttataaaaatattgctaatcttctgcttatttttcagcctttaaagtctgaaatactataaaacactgagagtatctatgtctttctgaatttaaaatgaaaattcatgtccatatggagacttacatattccccaatctttccatgaattgcatttttttctaatacttatctctgttaagactccattgaaagttaaacaaaaagccgatataatagtttgggttttttttttttgcttattttagtattttgaatcagagaatacttggccaagctcgtatttgtaaactaaaaccccttgttatttgtatcttctgcatttcagttttactgtaagaacatacattttgaaattatgaacatttttttcataaaaattaaatgctttaagaaatggagaaggaaaaatagcttttatcaatttttttctcctcaagattctgtaataaacctcaaagtctggtgtagaatggtattttcccgtttgaggtcttggtagttttttttttttttttaaacatggtgccacttttaattaactaaatgttacaaaattctcagcatttgtttttgtctggtagtattattgagtcttttcatacacttcttaaaatgtgaaaatctatgttttcagtattatgacagtatctgcagatactataataatatgctttggccaaatttgctgtttatagagtgaaccaagatgtcagttttgtattggggatatgttttacataaatagaactcatttaaaagtatggttcaagtactgctcttctttttatggggaaattgatttttaaggagcgattcttttcctatataaaagctattgaggcttagctttattcatacatgagtgatttggttataactcaatcaaaatttttatctttaaatctgagacaagtattatatttaaaactagatctattaatacattcatcactgcctgaaaatttgctgttctaatgtttgtgaattttcactcattacctagagtaaacttattgcatattttcataatcagtcaaaataataaaactaaaaacaaaaagtaaaaattagttcccaagtaaatatatcagtgtttcctgtgtttgggcagaagtgcaaagtagttttaatttctcacgttgtagaaaaagaggccaaaaaggtcaccttagtttatttttccaaaacataactttaggtattctaatgtattttgttagttgcttagaaatggaaataaaatatatgtgcttattaaataatgcacagtacactagattatagagtttatttttgcttttatgctttaaagaatgcatgcccaaaacactactaccaacaagaggattttttaaaatcacagaattgatatttatctcaagactatcttaagctaatgtacttctgttacataattaaactatttctgctattatttttaaagcagtattattttataaccaattctaaaattcagctttaaaaatattgaacataccttcctaccacttacgcttcaagtttcatttattgaataccagggtcatatcttagaattgtatataaaacaacatgtaacccattcatgaaaaacgtttttaagtattgctttttgctgctatgttctgcattgagcctagttttgccattgtcccctgaatgtagtattatctatagattatacataactacatctattgcttttggtggtaaatcaagatttagttgtaattttccagctgtgaaaatgttgccttgtatttaaaagggtttcatgaatggaaacctaagtaaaactaagctcattagtgacagacttgttttcttcttgttattcctccagcaactccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaacttaaaaaaaaaaa

SEQ ID NO: 284508 - DNA, 6030 bp, Homo sapiens
gggcgggcgggaggcgcggaggcagcggaggctgctcggccgcaaggaggcaggcgggaggccaggggtgcagaattggggcggggggctcccttcacccccgcagccctccgcccgggtccgtgtggccaggcctcacgtgcccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaagttttcatatgagtccaacaagcaatgaagacctcaggaaaatcccggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccatatgaaccatccaggaaagctggcaaattctctaacagttaataaagccaattgtattgtattgataattggacaaagagagagaaagaaagaaggaaggaaggaaaaacttgttactgaaagagactacactatcaggtttcattacatattctcctttattgtgaagagtagttttacctgtaaatattagcagggactatcaagagtgacctttgaagcaagctaaatcatttaaatgtttaaattgaaaatgggccagattctcaatgaataagtggttccttaggactcactcaggtgctggtactgacccactaatctgccataggcccagaaatatcttcagaagtacgtgagttgttcctcaggaatagatttttcataaagcagaattgatcctgtggctggtttctcagaaatcagtttgtagaaatatttagcttcaggaatactgctcgttataaacactactaaaaaaacagtttatattttatatacacatatgtacatgaatatatatatattcatgtatcttgtatataaaatataggcatatacctcatatatacatgtgtttttagaacatttagaaacaattgattgcctctaaagttaggctaccaatttcttgatttgaaaatgtgtgtgctctattgatgcaagacaagtcatccttcctactgtcatggtttgttatagagaagctgcttcaaatcactcttgactacatggaccttggtttcaaagtgagctgctatatattattctagcatcaaagtttttctctttccccaaaagtgatgatctcaagtccttttttaaagaatgacaaattttaggagacttcattaacttcataacagcatgaatttatttgaattaattaacatttgagtttgtttaaggtataagcagaagataagctaatatagcttgttttgttgaaattctgcatgcctttaaatcactagcaaagcaaatattataaagttatatctgaaaataattgtgggaagtatgtgattgcctggtgtgtctgataacccaaagcagcgggcagattccaggaatgaagaattaggcttggtttcaggttacataaataatagagcagatggttgcctttgggtcttgaaccaaaataagacttactaaaggaagagtgagtttttagaagagaactttacgagcgtgacattatgcattactccacatccaccctttaagaattgatttattacaaaattatgttctattttaaagtccactcccccaaaatactgatttcttccatggattatttttatatgatttgtacaaattttttctgaaatttaagttgacaagcaatgttataaaaatattgctaatcttctgcttatttttcagcctttaaagtctgaaatactataaaacactgagagtatctatgtctttctgaatttaaaatgaaaattcatgtccatatggagacttacatattccccaatctttccatgaattgcatttttttctaatacttatctctgttaagactccattgaaagttaaacaaaaagccgatataatagtttgggttttttttttttgcttattttagtattttgaatcagagaatacttggccaagctcgtatttgtaaactaaaaccccttgttatttgtatcttctgcatttcagttttactgtaagaacatacattttgaaattatgaacatttttttcataaaaattaaatgctttaagaaatggagaaggaaaaatagcttttatcaatttttttctcctcaagattctgtaataaacctcaaagtctggtgtagaatggtattttcccgtttgaggtcttggtagttttttttttttttttaaacatggtgccacttttaattaactaaatgttacaaaattctcagcatttgtttttgtctggtagtattattgagtcttttcatacacttcttaaaatgtgaaaatctatgttttcagtattatgacagtatctgcagatactataataatatgctttggccaaatttgctgtttatagagtgaaccaagatgtcagttttgtattggggatatgttttacataaatagaactcatttaaaagtatggttcaagtactgctcttctttttatggggaaattgatttttaaggagcgattcttttcctatataaaagctattgaggcttagctttattcatacatgagtgatttggttataactcaatcaaaatttttatctttaaatctgagacaagtattatatttaaaactagatctattaatacattcatcactgcctgaaaatttgctgttctaatgtttgtgaattttcactcattacctagagtaaacttattgcatattttcataatcagtcaaaataataaaactaaaaacaaaaagtaaaaattagttcccaagtaaatatatcagtgtttcctgtgtttgggcagaagtgcaaagtagttttaatttctcacgttgtagaaaaagaggccaaaaaggtcaccttagtttatttttccaaaacataactttaggtattctaatgtattttgttagttgcttagaaatggaaataaaatatatgtgcttattaaataatgcacagtacactagattatagagtttatttttgcttttatgctttaaagaatgcatgcccaaaacactactaccaacaagaggattttttaaaatcacagaattgatatttatctcaagactatcttaagctaatgtacttctgttacataattaaactatttctgctattatttttaaagcagtattattttataaccaattctaaaattcagctttaaaaatattgaacataccagggtcatatcttagaattgtatataaaacaacatgtaacccattcatgaaaaacgtttttaagtattgctttttgctgctatgttctgcattgagcctagttttgccattgtcccctgaatgtagtattatctatagattatacataactacatctattgcttttggtggtaaatcaagatttagttgtaattttccagctgtgaaaatgttgccttgtatttaaaagggtttcatgaatggaaacctaagtaaaactaagctcattagtgacagacttgttttcttcttgttattcctccagcaactccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaacttaaaaaaaaaaa

SEQ ID NO: 284509 - DNA, 980 bp, Homo sapiens
cacgcgtcgcggacgcgtgggtcgacccacgcgtccggacccacgcgtccgctccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaacttaaaaaaaaaaa

SEQ ID NO: 284510 - DNA, 759 bp, Homo sapiens
agattctctttgttaaagaataagcacccttccggggatggtaggcagggaggcgtggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaacttaaaaaaaaaaa

SEQ ID NO: 284511 - DNA, 1250 bp, Homo sapiens
gggcgggcgggaggcgcggaggcagcggaggctgctcggccgcaaggaggcaggcgggaggccaggggtgcagaattggggcggggggctcccttcacccccgcagccctccgcccgggtccgtgtggccaggcctcacgtgcccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtccacgagaattcgcaaggcttcaagttcgttttctggtccctagctttggaacgggggtgtccatgttatcttcgccgcctattatctgtgaaccacaagaggatactccccaatgtttctaaacccctcggtggtgtggccacctagcggccgcg

SEQ ID NO: 284512 - DNA, 1759 bp, Homo sapiens
gggcgggcgggaggcgcggaggcagcggaggctgctcggccgcaaggaggcaggcgggaggccaggggtgcagaattggggcggggggctcccttcacccccgcagccctccgcccgggtccgtgtggccaggcctcacgtgcccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaaggtaagcttaatatgggggaagttctactatttgggaaaatcttgtacttgaagg

SEQ ID NO: 284513 - DNA, 1588 bp, Homo sapiens
acccaggtctccctggagcccgccgacctgaagcagcggccgcaccgcgtatgcgcccgggtggtttctgggagtaggcgaggactcgcagtgcgcatgtgcagcccccacggccccgctcccagtgaccggaatgcagaggcgtacatggctaagagacgagctacctgggacacaaagatgagaaccacaagcatgagaacatgaggataaatacactttggggaaaaagaaaacagacagaggcagcagagaaggaagacgagaagaagagaaaaagagaagtaggaagaggatgaattcatttcgcttatctggcaaatgtgtaatctgagtaatagagatggtgcaatgctgggccacagagcttgccccaggtccccaagcaaagtcagtggcactgcctggactggaagttcatccccatccattttcacgtgcggagtctcagggctcagtaaagaaccatgattgacggaggtcacacagcaactggtatgacagggacaggtttccggaattccagtgtcttaacaccaaagcctgtagtatttctcagagagaacaacaccactgctcgtgtgtgctcagaagaaagtttagtggtcgtaacatccaatacatccaacctgcagatcaatacacaaagaccctggaggaaggtggggcggtaacttgtccaaatctccaaagaaaaggtaagaatggtgatcatcaaagccgctgacatttgaagggtcattgtgtgctggccattgctctgaggttcccttaattctcacaaccaccacctaaattttaacatcaaattctaacatcatcctcactttacctatgcggaaactgagacacagagtgtgtctcttgcccggggccctgaaatagtaagggagcacagcaggggtaccagacattatttcacaaaaagggaaactgaggcccagagagggtgaaaggtcaccggctcaccctttccgggacgagtggtatagggtaggtggcctcaaagacagagcttggctgagaacccacagccccttcacatcagctttctcccctcccgtgggcagctatgaagtcacaggggaactgggaggggccgttaccatggagactcgaagcccattcagagaatagggtggaatctgcgagtcgccctcatctcccagggcaccactttggagccagcattttcggcctcggaaatgagacccagagcgcctcgcgcgagcagccccaacctccccgcagacgacatgcgacaccgcccgggtgacccaggctcgggaatctctaggcttcacggacgcagaaccagggaagacacgcctcaatgcgcgtgtgcaactctatcccgtcctttaaagaaggccatgtggcctcttcaccaatcggaatcctgctttttccctggtcccgccttattcccagacttccggcgtctcgctggccgcaaaacaaccctaaactacagggctcggcgactcccagagacttctgggtattgtagtcctaaaggttcagagcgacaagagcacgttttagtaaaaagcagcttagaataaaatgcctgcactagtaatgattc

SEQ ID NO: 284514 - DNA, 925 bp, Homo sapiens
agagaatcaagcggttgccttctgagggctgaagcgtatatcagtaccagaaccagctggggacttttctcagatcttcactgtgagaacctgctagagtccttggagataaaactcacgaaagtgtaaagatagctctatggcaaggtcttcttggagtttttaattctcagacttaaccacattcagcttccagcaattcatcaattagagttcaggttttcctaaccttgttctggttcctgcagaggcacaaagattactgcttgtgagtttctgctctggaatggatgttttcttttaaaaatggtttattgaagtatcatgtacctatcttaagtgtacagcacgatgatgtgtatgcccatgtaaccatcacctagaaggatgagaaccacaagcatgagaacatgaggataaatacactttggggaaaaagaaaacagacagaggcagcagagaaggaagacgagaagaagagaaaaagagaagtaggaagaggatgaattcatttcgcttatctggcaaatgtgtaatctgagtaatagagggaacaacagattggacccaactaggatctcccttggagtggatcagactgatgatttccactatccaaaagcttcctgaataaaaaagaagaaggtgtcacctacttcaatgtgacattgaccccaccactacatcttaaagaccctgtgttatttcagcaataatgcccctgcccatcaatccaactggtgttttcattcctcatcttagtcttaagtgcattcaactgatgctttattctagaggtactctgttcctttcacctttatgtggccatctttaccctgttttgtcataatactcttttaaaaaaccaacttttaaaatgttaaattgtggtaaaatacaaacaaacaattgactggcttaacca

SEQ ID NO: 284515 - DNA, 609 bp, Homo sapiens
agagaatcaagcggttgccttctgagggctgaagcgtatatcagtaccagaaccagctggggacttttctcagatcttcactgtgagaacctgctagagtccttggagataaaactcacgaaagtgtaaagatagctctatggcaaggtcttcttggagtttttaattctcagacttaaccacattcagcttccagcaattcatcaattagagttcaggttttcctaaccttgttctggttcctgcagaggcacaaagattactgcttgtgagtttctgctctggaatggatgttttcttttaaaaatggtttattgaagtatcatgtacctatcttaagtgtacagcacgatgatgtgtatgcccatgtaaccatcacctagaaggatgagaaccacaagcatgagaacatgaggataaatacactttggggaaaaagaaaacagacagaggcagcagagaaggaagacgagaagaagagaaaaagagaagtaggaagaggatgaattcatttcgcttatctggcaaatgtgtaatctgagtaatagaggtgagtgtttctaagaggatgctgttcagagacaaatacactgtttaaaatccattaaa

SEQ ID NO: 284516 - DNA, 429 bp, Homo sapiens
tctgagaagtccgggaaacatgtttctgcagaagaaaaggaaaaggataagagtaagctttgggaagaaagcactgctcaggtgaaggacaaaaaggcaggtctccctgggttggaggaaggtggtaagtatggccgttgagttgagctgccatcatcctcatgcatggaagctgattttggtcattgcactatgccaaagcttgggaaatactactgtgacaatgctttagggattcaagattttttgctgtgtctctctttgtcacataatcatacatgtattttcagtttgctgtttgccttctcttgcacttaaaaaattactcgataatttctatccagcctgtttcctattttcggtaaattccctcctatgggaattccatctcaggaatgaaataaagcacagtatgtgtctgaaggcaag

SEQ ID NO: 284517 - DNA, 251 bp, Homo sapiens
tctgagaagtccgggaaacatgtttctgcagaagaaaaggaaaaggataagagtaagctttgggaagaaagcactgctcaggtgaaggacaaaaaggcaggtctccctgggttggaggaaggtggaaaggattcattgccattagcctatgtcctggctcttggtgcaccaacaatgaatttcatggtggatgaaacagcagcaatcaactcaacaaggaatcccagcaattggtgcaaaaaacgtataca

SEQ ID NO: 284518 - DNA, 1610 bp, Homo sapiens
acttgggttcagggagccaaggtggtttcattttgtctgggttgtaggggaatggttggagataagggtagaaaggtggtttgatgccagggcctagaggacctgagaagtagggagacaagaaatgattaagtagggcatcattttgcaggtttctgtgtggtaatgaggtcatttagactcagtgtactagtctgattgtgttatgtggcctgggttaaattggagagaggaggtggcagggaggcagcatagcagaggaagccctgacttagggaagtaaagtctttctgatgtttggttttagtggtaataaagggcttacttgggtacattttccttacctttctccattcccataactgttttcatgtaaaatggctgctttgcttgaaacgggttgcagtacctagggtcctgctctctgacatctataatactcagggggcagcctcttgggaatttgggggaattgtagagtcctttgaaatacagattaaaataacagattcatagcagctttcaagagtttgtatttttcctccttctcggtgtgcacctgtcatttggcttcttcccacttgttgaaacactaaataatacagataatgccttgtctacactggcttgctttcaaagactcagaacctcaagcttaggtaaaaggattccagccacacatttcctctcctgctcggtgactcactaggaggaattcccccgtaaggcaacagtccttgagtgccaggctatgcccatgagcaccagtatggtctgagaaggttggagtctggcaaacaaggccaagggctctgttgttgggctcacaagtaccttgactatcgcccacaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggtgaggagtgcaattcccatgggaatgggggtgggtataaggcaatggtttcatgtatctgatctatctacattgaccagtcactggatacctatcagtgctctgggcctagtgccagaatataagtattagacagggttccttgtcgtcagacgacccattatcttatgaaagaggtgacagtgaaaatgggtaattaatagaatgcagttcatcagtaccgtaatacaggaagcacaggacagtgtgggagccagggaagatctatgtatgtaattatatatgtgtatatggtagaataggtgactggaaaggcatcttaggagaggtgacaggattaatcttaaagggtgagtgagtaagtgtggaagggcattccagataaaaggagcagtgtgtacaaaggcctgtggagcatgactggaccagtgaggaatagtgagagatgaagctagaggacccagattcccaagggcctccagttctgtgcttaagagttttgactttatcttgaaagtactggggaggcattgaatggctcctgcaggggaaagtgacatggtcagatttgagttttaggaagatccact

SEQ ID NO: 284519 - DNA, 719 bp, Homo sapiens
cacatcaagcccgaatgatttcctattcgcctacacaattctccgatccgtccctaacaaactaggaggcgtccttgccctattactatccatcctcatcctagcaaagaatttgcatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagtgagtatttccaggggtggggctggcagttggaagctgctaatttctttttcttttctcttttttttgagacagtctcgc

SEQ ID NO: 284520 - DNA, 166 bp, Homo sapiens
gccccaagggtgggggggggcgggctttttttgggggcccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284521 - DNA, 159 bp, Homo sapiens
  misc_feature (22)..(22): n is a, c, g, or t
  misc_feature (27)..(27): n is a, c, g, or t
aaaaaaaaaaaaaaaaaaaaanaaaanaaccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284522 - DNA, 11693 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284523 - DNA, 10438 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagc

SEQ ID NO: 284524 - DNA, 11775 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggtgaggagtgcaattcccatgggaatgggggtgggtataaggcaatggtttcatgtatctgatctatctacattgaccagtcactggatacctatcagtgctctgggcctagtgccagaatataagtattagacagggttccttgtcgtcagacgacccattatcttatgaaagaggtgacagtgaaaatgggtaattaatagaatgcagttcatcagtaccgtaatacaggaagcacaggacagtgtgggagccagggaagatctatgtatgtaattatatatgtgtatatggtagaataggtgactggaaaggcatcttaggagaggtgacaggattaatcttaaagggtgagtgagtaagtgtggaagggcattccagataaaaggagcagtgtgtacaaaggcctgtggagcatgactggaccagtgaggaatagtgagagatgaagctagaggacccagattcccaagggcctccagttctgtgcttaagagttttgactttatcttgaaagtactggggaggcattgaatggctcctgcaggggaaagtgacatggtcagatttgagttttaggaagatccact

SEQ ID NO: 284525 - DNA, 10849 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatccgtggccctatcgagggtaccagctcgagtcgtaatatgtaa

SEQ ID NO: 284526 - DNA, 10533 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggaacatttctttggtttgtattattaactgtacatacgttgaatctaaataatgctttgagctggaaacccattgctgtgatgtggcttgcctgaggtcccattatcaatgacagtgacgagtgtgtccaatccagtaggtgtgtatgttcataaat

SEQ ID NO: 284527 - DNA, 11581 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccactcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284528 - DNA, 10051 bp, Homo sapiens
  misc_feature (12)..(12): n is a, c, g, or t
  misc_feature (45)..(45): n is a, c, g, or t
  misc_feature (47)..(47): n is a, c, g, or t
agctgcatgccnaggttatctagaggatcccgtctcctcttctgnancccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccactcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284529 - DNA, 7290 bp, Homo sapiens
aataggaattccggctctggggaattccggctctctgggacctccctccttggctaggtttggccacagctccatccctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccactcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284530 - DNA, 6940 bp, Homo sapiens
accgtaaccaaatcaacaacaacctatttttctgttccccaacctttttctccgacccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccactcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284531 - DNA, 6301 bp, Homo sapiens
agggatgatgctggagttaatgacaatgtctgagttggaaagggtccctgggggttccccgttcccaaagagagtgtctgagatggagatgagcctccaagagtgggtgctaaagctggggctagggccagtgtctgcgtagaagccgggctcgggagaggtgacggaaccggggctggtagcatagtttgagttgatgatggagccaacaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284532 - DNA, 5756 bp, Homo sapiens
  misc_feature (69)..(69): n is a, c, g, or t
ctttgcaccgtattgtgtgtaacatgcgcgacccagcttccctgacttaagactcatccagtatgattncggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284533 - DNA, 5999 bp, Homo sapiens
attgtagatcttaattttgaatattcagtcattctgctttggtagcatacaaggaaagatcagttttctctaggagagaagttacttaacataacttctgagaaagaatagttatttaacataaaaaagaaagttatttaacataacttctgagaaagaatagttctcattgataacttggaaaactacaaaaagcatagtgtatttttggatcccatggtttctatatatttatttccatctgggaagaacagtcaggttttgatgtggactctgagggtgctgattacttcctctttttctctcacccccaggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284534 - DNA, 4973 bp, Homo sapiens
cacatcaagcccgaatgatttcctattcgcctacacaattctccgatccgtccctaacaaactaggaggcgtccttgccctattactatccatcctcatcctagcaaagaatttgcatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284535 - DNA, 4124 bp, Homo sapiens
gaggtgaggtgactctagcaggatccctccgccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284536 - DNA, 7772 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgcccgtttgctcagacctgccagctgctcagca

SEQ ID NO: 284537 - DNA, 5654 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccacgtgccatcctcactcactgggccagcctcttctccaatgccgattcccgactcctctcccctgctagtgcctgtgtcctctacagtcta

SEQ ID NO: 284538 - DNA, 1528 bp, Homo sapiens
acttgggttcagggagccaaggtggtttcattttgtctgggttgtaggggaatggttggagataagggtagaaaggtggtttgatgccagggcctagaggacctgagaagtagggagacaagaaatgattaagtagggcatcattttgcaggtttctgtgtggtaatgaggtcatttagactcagtgtactagtctgattgtgttatgtggcctgggttaaattggagagaggaggtggcagggaggcagcatagcagaggaagccctgacttagggaagtaaagtctttctgatgtttggttttagtggtaataaagggcttacttgggtacattttccttacctttctccattcccataactgttttcatgtaaaatggctgctttgcttgaaacgggttgcagtacctagggtcctgctctctgacatctataatactcagggggcagcctcttgggaatttgggggaattgtagagtcctttgaaatacagattaaaataacagattcatagcagctttcaagagtttgtatttttcctccttctcggtgtgcacctgtcatttggcttcttcccacttgttgaaacactaaataatacagataatgccttgtctacactggcttgctttcaaagactcagaacctcaagcttaggtaaaaggattccagccacacatttcctctcctgctcggtgactcactaggaggaattcccccgtaaggcaacagtccttgagtgccaggctatgcccatgagcaccagtatggtctgagaaggttggagtctggcaaacaaggccaagggctctgttgttgggctcacaagtaccttgactatcgcccacaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaaaaaaaaaa

SEQ ID NO: 284539 - DNA, 4724 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattctcacgcccagcatctacctcactgtgacccgc

SEQ ID NO: 284540 - DNA, 1218 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtgggctattcaagcaacagtcccgactggtggggccagtgaaggcgca

SEQ ID NO: 284541 - DNA, 454 bp, Homo sapiens
gtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcaggtgaatatgtggtcatgaagcaggagctggggagggtggccattggaagagcaggtatgatgagcagtaagccttggtcttaccctttagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagca

SEQ ID NO: 284542 - DNA, 857 bp, Homo sapiens
tcctgacctcgtgatccacccgcctcggcctccagaagtgctgggattacaggcgtgagccaccgcacccggcctttttttttttaattttgaggcagggtcttgttctgtggcccaggctggggtgcattggcatgatcatagctgactgcagcctcagctccctgggctcaagcagtcctcccgcctgagcctcctgagtagctgggactacaggtacatgctaacatgcctggctaatttttgtattttctgtagagacggggtcttactatgttgcctagggtgatctcaaattcctggggtcacacagttccccaatcttggcctcccagagagctgggattacaggtttgagccaccgtgcctagccttttattttggagtaagggtgtacatgtgcaggtttcttaaatggggtatattgcatgatgctgaggtttggcgtacgattgatcctgttactcaggttgtgagcatggtactcaactggtagtttttcagccccttgcccgccacagtcgtttctggcgtatattgttctcatcttcatgtccatgcgtacccaatgtttagctcccacttgtgagtgagtacatgtggtatttggttttctgtttctgtgttaattcacttaaggataatggcctccagctacatctgcgttgcaaaggatgtgattttgttcttctttatgactgtgctttctttcttgtggcagcggatagacatgggtcgatttgaccttattggcctggaaggtcgtgtctctcgatatgaggcagacacatttctgccccggcaccgcctctctcgccgggtactgttagaagtggctactgctcctgaccccccac

SEQ ID NO: 284543 - DNA, 360 bp, Homo sapiens
ctgcctgagccctgacctaatttcaagatctatttgctggaatcttggaggggaagaaaatctaaagttgtcagattacttggatgtttgacttcatgttgtgggagtgaatgccttctgggaaatgggaagcttgggggtatgggaaagatgggacagggagtagaaaggctcaggaaaagaattctggggctaactcatcctctctctccacagcttcagcccccggagctgcccccttgaccatctcttctcctctccacgtgccatcctcactccctgggccagcctcttctccaatgccaattcccaactcctctccccttgctagtcctgtgtcctctacagtctcagttccat

SEQ ID NO: 284544 - DNA, 6676 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaaggaatgtggtgcacctcgtgtcagcaggggggcagcaccatctcatcagccagcctgcccatgtggccctcatccaggccgtggccccgacccctggccctacccctgtctctgtgctgccttcttcgacccccagcaccacccctgcccctactggcctcagccttccgcttgctgctaaccaggtgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggtaagttttacttcctcaagagggaacaggaagttgagtttctttggagtgttggtagggtggatggaacagtgatgtcacatttaacctggtgaattacaaagcttaatgttatggaccaagtacttgagtgacatttggacaagtcccttctcttccctgggcgtgtacctcatgatccgcctgcctcagcctcctgaagtgttaggattacaggggtgagccaccacgcccggcctcttttcccgttttttaacccgcacggtaataaatgggcagtaaaaggaactcttctctgtcccttttatgatttccggtagctgtttctttcctgtactatgtatataggcccatgtctgtgtagtacttgagttaaactcacagttcagcttaagtaaaccagaactaaggagaaggaaggtccagtgggtccctccacgccctctggcttttccccactgtaatcagagctgctgcttagt

SEQ ID NO: 284545 - DNA, 9302 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagaaggggtgagagacaggtacattctctgacctaccactgggtcctggacgcagctcggacctttggcgctggccccagtcctccactgcgtgtccgccgagacttccgcagcgcgtcttccgcttgtggtttcggcctctggtgccggtcccttgcgctgtcgaccatgggataatcccgggcttgcctgtgtttcccaaggactgaggcgctgacacaccctgacactctgcgcctcgtggctccaccaacatgcaagagacgccacacaagacacggaatgaccagcaaacacatcgcgaacacgcagccctcgcacaagcagggaccacacgaaacccacagaaccgaccacacgccccacagcacgcaaagcccacccagcggaacactccgcaacaccaaagacctcgacacagaacgacacggcataaccaaacccaaagcacctcacatctgtacagagcgaacactcacatccgaacacacgcaccgcaacaccctacccaccccctgccacacacgaaaaccactccactcaggacagcatcgccacacccaaggacgcaaacaaacagacagcgacaccaccaagaaaccgagggccaacaaagagggaacccgcgactacaagacccaaggagaaaacacaaaccaaaaaagaaaacccacccccaacaaaggccccacagaaccacccccagaccaccgcagcaaaggagaccacaacacacaacatgcacgacaaaccacgcggaaaaaaaaacgaaaccaagcaaacacagaaccaacacaaacagcgccagaaaaacgccgacaaaaacagaccacagccgaacaacaaacaaaaacggcacgccgggaaagacacaacacgacaaccacccaacgaacgaacacaaacgcacccggacaccaacacacacgactcccaacacaccacaacacacatcaccactatcctacactttgctcactataaaatacatcttctactatcaatacaattatcacagccataaccccagcagcaaaaaccaagaactcacatctataaaacaactaaacctgcactcaaaaacacactcacaaacaaccacagccaaatacaacaaacaaataaccacaaccaatcacttcaaccccagccaccacactccaaccccccacactaccccc

SEQ ID NO: 284546 - DNA, 5736 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacatttggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagc

SEQ ID NO: 284547 - DNA, 4395 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctgtaagttcccagggctctgtggtgagggacttgagatgggaggaaagctcaggaccatgagagcatcaaattttaggcagctgggtcaggcatgatggctcatgcctataatcccggtgctttgggaggccaaggtgggaggtttgcttcagccaggagtttggagctgcagtgagccatggttacgccactgcaatcatgagcaagaccctgtgtcaaaaaaaattgaggcagctaacatatgttaggcattatgccagacattgtcagatcataattaagagcccttaagaaattgacatagggagatgacacata

SEQ ID NO: 284548 - DNA, 3477 bp, Homo sapiens
gcggccgagacggcggcggccattttggtgaggcctcgggagcggcagcggcggttcgctgggagtagcgtctgccctttttcccacccaccgtccgcatctgtgtgctgcgcgaagaggcagtggaggcaaggcggtggcagtagccgcagtctccaggggagtttaaaggccgcgaaggcggtggccaagagggggccctcccccctcctaggcgggagggggggtggtgcgcacgcccccgaggacgcaggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccaggtaagtatgattccattaatatgaaatgtaaaggttatcggcattactccaaccatgtacctcttttcgttagactggggtctgacttttgcatcctcatgactcccctatcattcactatgca

SEQ ID NO: 284549 - DNA, 468 bp, Homo sapiens
accttagacccttcccttttttatcttttgccatacagataaagcccccaccctctgctgtcacacagcgcaacaaacagccttggcatccagatgaagatgatgaagagtttactgccaacgaagaggaaggtcagggctgttcggtttgtcctattgccccttaccccttgaatgaattgtctggacctaacctttcaggctttctcatctgtttcatttggactgtgtcctgtgcctctagcctctatccctattaatcttgcttctgtctctttcctagcggaggatgaagaggatactatagcagctgaggaacagttggaaggggaggtggatcatgccatggagctgagcgagttggctcgagaaggtgacatttaccagacattttactaagcatccacttggtgtctgcggtgtgcagtaccaaggataaagagatgaataaggcactttgtatccacc

SEQ ID NO: 284550 - DNA, 368 bp, Homo sapiens
caggcaaggaaatttgaggttgttgcatctggaagtaaacatgtagctacttcttctaataaaacagaggctgctttaaataatttctattaatagccttttctgaacaatcacagagaaagtcttctgaataatcatactgagaacttaaacttccacaggagcactgagatctgctataatcaacactcttattggaagcattactgttccgtgaaaaatcgcctgtgcctgggcttctcttgcatgctgcagacctcctattgttttctaatgccacgccgaagaaatgctcatctatatttgtttttgttagatcagccaaagacatagcaaacaacctaataaaagaaaagtaaaacctaata

SEQ ID NO: 284551 - DNA, 640 bp, Homo sapiens
acttgtgcatgcctctgcccccccgggccgcggaactctcctggggcgaccccgagtcccaccccgctgctccgtgccgtcctcgcagctcgagccctcctccagcccagcagtgctcccgcagcgtctggccgctggtcgtcggcagacgaaagggcttgaaccgcggctgaccttagcctttgtccctcggcctagttccgcagctgccgtcagaggccgccagcccctcccccagcatgtttgggctaagccgcctcctttccgcctgcgttggagagagaggtaccagaaggaatgaaaggactggggcttgtctccatggcaactgaaagaaagagagaaaaattggtcacctccaggactgagaccctgacccttccaagcatccccactaccaaaggctgcccaagcccggaaggatcccatcccgttctgtactctgaggtcacttcctcactccgtcaaatttcactggactgtgggctaattaaaagtgcctccgtattagcggggcgtggtggcccatgcctataatcccagctacttgggaagctgaggcaggaaaattgcttgaacccgggtggcggaggctgcagtgacccaacattgtgcaacaagagcgaaactccgtctcaaa

SEQ ID NO: 284552 - DNA, 829 bp, Homo sapiens
acttgtgcatgcctctgcccccccgggccgcggaactctcctggggcgaccccgagtcccaccccgctgctccgtgccgtcctcgcagctcgagccctcctccagcccagcagtgctcccgcagcgtctggccgctggtcgtcggcagacgaaagggcttgaaccgcggctgaccttagcctttgtccctcggcctagttccgcagctgccgtcagaggccgccagcccctcccccagcatgtttgggctaagccgcctcctttccgcctgcgttggagagagaggtaccagaaggaatgaaaggactggggcttgtctccatggcaactgaaagaaagaggtgggttataaatccttcgccaccctcctgtggcgaaggaggggaagtgggagccgggaagtagagttggccttttgcaggagagtctggagcccctttctgggtgatgcattgggggccatagaaggatttggctgccgctttggagcatggattttttttttaatcatcttcctttctcttttggagagaaaaattggtcacctccaggactgagaccctgacccttccaagcatccccactaccaaaggctgcccaagcccggaaggatcccatcccgttctgtactctgaggtcacttcctcactccgtcaaatttcactggactgtgggctaattaaaagtgcctccgtattagcggggcgtggtggcccatgcctataatcccagctacttgggaagctgaggcaggaaaattgcttgaacccgggtggcggaggctgcagtgacccaacattgtgcaacaagagcgaaactccgtctcaaa

SEQ ID NO: 284553 - DNA, 682 bp, Homo sapiens
cctgtagaatgtggtttgtagagcacggggttgtgaataagaactgactgtgaggcctagccatacaatttgtagtttgcatgccccccaccccaggaaggttaccctccagacctcagaggcctcacctcttcagcagatactacagtccctgagaagacgatcaatgcgagaccatgctgtaagctgaaagggttgtatagatgttaaaaatacatacataatttttgttttttaataatagaattttgatctctggtggtagaattactcaggttcagaatccttggctccagaagtctcccttggcaatctctaaaaatataccccaaacaaacaacccatagagaatcagaagggaaacaggaagcctcctcctctggaaggagaaagaatccgcagcttaatcgctattgcagagcgggaaacagggcagggagcaggagacttgagtttagctttgggaagatgaatgaatgaataaatgaaccattatcagctgccaaccgtgtgccaggcactgttagaagcagaatagtaatttgtttagtcctcaccaaaaccctatgaagtaaggtggtatttttaccatttgacaagtaaggaaataggactaattagttggaggagttagaattcaaattcagaccatctggcctgaaagccttgctcttaatcacta

SEQ ID NO: 284554 - DNA, 1226 bp, Homo sapiens
caattttggcctgcaaagacttccttctctcgcctctactacccaactcctgtgagggactcaggcatagttcgggcggaggcagaaagagcgagcgcgcgaagaacttcggtattgaggttgctaaggcttctcctcatgtgcttcaagagaaagtagcctttaactgtggaaaggacaccaggggaccggggaaggggagagcagtggtaaaaatgagccagaagcagataaggcgactgcccgccccgcggagagctgccttctgggacttgtagtgcgcggggcccccggagccggctggctgcgcaggctcggcgttgcgctggccccaccccggcgggcggagtaacggtttggaatcccccggggtcagcgagcgcttgtttcctccgcctggtgtagcaaaagtgtaaacacgcgcgctccggaaggcgccctccagtgggaggttgctcaggggatggcggagctgtgaaactcggagctagaaggaaagtctcaacgcttgtctaaattttgctttgtcgtgacgagctacctagacccacgcagagctaacttgggagagcgcttgtgacgctacgaacctctcgaacacctgacgactgggcgccagggccggatggagggtggagagccagtgcggcgcagctgcctcctcttaaccgggacaccttgcaggaatgtgcggagtggagctaacgggagcggatagaaaccgagggaggggaagagagcgcgaaggcttggccggaaggagaggttaaaaaggaaaggcctaaaatgaggaagagagttaccacaacaagcagtacctagttccagttcttggtcccaggagtttgtggttgttgctgctttcatcttcctcagccaacacaaaaggaaagtgccaaggggcgattcctaggaccttcagtgcagtctccaccttgcggacttggctcatttgtgtccactcctttctccagccttttacacttgatgctcttggatgaatagaaaggagcacaattaatggaaaacacaagcttgggagtcaagggatttgggttctattcttgtcctcccttggtgacgacatcattaccttgggttattcaagctttcagtgccagagttcctatatcaataaaagattattacattgacctcttagagaaatgttttcatggtactgaattgcaaataaagtatgtgtagcgatgtgttaaaaaaaaata

SEQ ID NO: 284555 - DNA, 1307 bp, Homo sapiens
caattttggcctgcaaagacttccttctctcgcctctactacccaactcctgtgagggactcaggcatagttcgggcggaggcagaaagagcgagcgcgcgaagaacttcggtattgaggttgctaaggcttctcctcatgtgcttcaagagaaagtagcctttaactgtggaaaggacaccaggggaccggggaaggggagagcagtggtaaaaatgagccagaagcagataaggcgactgcccgccccgcggagagctgccttctgggacttgtagtgcgcggggcccccggagccggctggctgcgcaggctcggcgttgcgctggccccaccccggcgggcggagtaacggtttggaatcccccggggtcagcgagcgcttgtttcctccgcctggtgtagcaaaagtgtaaacacgcgcgctccggaaggcgccctccagtgggaggttgctcaggggatggcggagctgtgaaactcggagctagaaggaaagtctcaacgcttgtctaaattttgctttgtcgtgacgagctacctagacccacgcagagctaacttggtatatgccccggttcccatctcttaagtctctttacagttgaaacacgtttataatgcttgactgccactcactttctagggagagcgcttgtgacgctacgaacctctcgaacacctgacgactgggcgccagggccggatggagggtggagagccagtgcggcgcagctgcctcctcttaaccgggacaccttgcaggaatgtgcggagtggagctaacgggagcggatagaaaccgagggaggggaagagagcgcgaaggcttggccggaaggagaggttaaaaaggaaaggcctaaaatgaggaagagagttaccacaacaagcagtacctagttccagttcttggtcccaggagtttgtggttgttgctgctttcatcttcctcagccaacacaaaaggaaagtgccaaggggcgattcctaggaccttcagtgcagtctccaccttgcggacttggctcatttgtgtccactcctttctccagccttttacacttgatgctcttggatgaatagaaaggagcacaattaatggaaaacacaagcttgggagtcaagggatttgggttctattcttgtcctcccttggtgacgacatcattaccttgggttattcaagctttcagtgccagagttcctatatcaataaaagattattacattgacctcttagagaaatgttttcatggtactgaattgcaaataaagtatgtgtagcgatgtgttaaaaaaaaata

SEQ ID NO: 284556 - DNA, 735 bp, Homo sapiens
agtcaaccgcgccggagtcgcagcgagcgcgtgcgcactgccttccggaggccgggaggcggaagtccaagcagggagagcgcttgtgacgctacgaacctctcgaacacctgacgactgggcgccagggccggatggagggtggagagccagtgcggcgcagctgcctcctcttaaccgggacaccttgcaggaatgtgcggagtggagctaacgggagcggatagaaaccgagggaggggaagagagcgcgaaggcttggccggaaggagaggttaaaaaggaaaggcctaaaatgaggaagagagttaccacaacaagcagtacctagttccagttcttggtcccaggagtttgtggttgttgctgctttcatcttcctcagccaacacaaaaggaaagtgccaaggggcgattcctaggaccttcagtgcagtctccaccttgcggacttggctcatttgtgtccactcctttctccagccttttacacttgatgctcttggatgaatagaaaggagcacaattaatggaaaacacaagcttgggagtcaagggatttgggttctattcttgtcctcccttggtgacgacatcattaccttgggttattcaagctttcagtgccagagttcctatatcaataaaagattattacattgacctcttagagaaatgttttcatggtactgaattgcaaataaagtatgtgtagcgatgtgttaaaaaaaaata

SEQ ID NO: 284557 - DNA, 977 bp, Homo sapiens
tcgggaggggcggggcctgcaagaagagtggagggcggagggcagaagggactggggaaggggcgaggcctggaagaatagaggcagaggcgggagcggccgatcttggcggatcccgcctcctcgcgactcggcccccaggtcacatccctccgtcggtgcccgccacccactcaccgtggggctcccgtgcggcaggtacaccgggtagtcgcgagcggtctgcggcggcagggaccccaccagccaggggagcagcacggcctcgggcgtccccagccgccaccaaccctctgttgctgccaccacccggccggacaccaccagactgacgaaggtcgtgcccgcggcctcagcgaacccggagagggcttcctgggtacgggaggcaggaggactgggagtcagcagacaagcgtagggggtggcagcgacttcccagatgggcagggaatggggagaaacccacagccagccccgagctcgcgcagtggccatgctcctacgtctcaccctctctgagcctgagttccttcactttcatacgaagtcacatccccaactcacactgtgaagtctgtgaaatctgattaaacatctagcctgggcgggcaaactgaagctaataatgtaaccgcagcagctaccgttcatccaggcctgttacatgccgagtaggcaccattagcaacgtagagaagccaagtcacctgctgagagtcacatgcctgggaggccgccacaccaggcaagtccacaagagcagtatttaagtagaggtagctagagatctgagaggcaggaggaagaacatgcactgaggttggaaacttgttgggatctcaggactgtgaggtagctgggtggaagtagactgtggatttagcaacaggttagggggtgccaggtgccacaggccttcaaacaccaggctgaggagctgggaccttgtcctgggggaggtggaggctgccgga

SEQ ID NO: 284558 - DNA, 1037 bp, Homo sapiens
aggggaggagcctgctgttgccccagcaacaaccacggaaaccaagacgagcgcggtcgcggaagtatcgcggcttacatatctcgcagccaggcgggtcctgggagaggcgcgagccaggcctggtcggcgcccgcggagaaaagaagcagtcaagcccatgaactacaaccccggttgccgctttctcctctcctaaccgttaagtgcgctaagggccatggctgaggtgcacgtgatcgggcagatcatgggggccagcggtttctcggaaagtagcctcttctgcaagtggggcattcacacaggggcggcatggaagctcctgtcaggcgtgcgggagggccaaacgcaagtggacaccccgcagataggggacatggcttactggtcccaccccatcgacctgcacttcgccaccaaaggtcttcaaggctggccccggctccatttccaggtgtggtcccaggacagctttggccgctgccagcttgcaggctatggattttgccatgtgcccagtagcccgggcacccaccagctggcctgccccacgtggcggcccctgggcagttggcgagaacagttggcacgggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacgtcaccaccatccacaccccggacacccagtgatgggggaggatggcacagtggtcaagagcacagactctagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttaaaaaaaaaag

SEQ ID NO: 284559 - DNA, 1027 bp, Homo sapiens
  misc_feature (93)..(93): n is a, c, g, or t
  misc_feature (106)..(106): n is a, c, g, or t
  misc_feature (152)..(152): n is a, c, g, or t
  misc_feature (155)..(155): n is a, c, g, or t
  misc_feature (160)..(160): n is a, c, g, or t
  misc_feature (167)..(167): n is a, c, g, or t
  misc_feature (186)..(186): n is a, c, g, or t
  misc_feature (210)..(210): n is a, c, g, or t
  misc_feature (213)..(213): n is a, c, g, or t
  misc_feature (221)..(221): n is a, c, g, or t
  misc_feature (225)..(226): n is a, c, g, or t
  misc_feature (234)..(234): n is a, c, g, or t
  misc_feature (237)..(237): n is a, c, g, or t
ggtggtgacggggacgtccttggtcttgcacgccactacctggggagtctaatcactgggatggtctgtggggtgggagggcctacggatggntccgtaaaggtcncatgtccctcattcctccttggccctctccctagcttctccatgtnagntcctnctggtcntgaccccatctccttgctnttgggcccctattgtctctggctnacntccttgtnccanncagctcanagntgtgcatcccacgcctgctacaagaaaagtagcctcttctgcaagtggggcattcacacaagggcggcatggaagctcctgtcaggcgtgcgggagggccaaacgcaagtggacaccccgcagataggggacatggcttactggtcccaccccatcgacctgcacttcgccaccaaaggtcttcaaggctggccccggctccatttccaggtgtggtcccaggacagctttggccgctgccagcttgcaggctatggattttgccatgtgcccagtagcccgggcacccaccagctggcctgccccacgtggcggcccctgggcagttggcgagaacagttggcacgggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacgtcaccaccatccacaccccggacacccagtgatgggggaggatggcacagtggtcaagagcacagactctagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttaaaaaaaaaag

SEQ ID NO: 284560 - DNA, 347 bp, Homo sapiens
cttggtttccaggttggaccactcaccttctctgtgaccctgggcagaggctgtcccctcttggagcctcagtttcctcatttgttcttcatagggctgttgggaaatcttgcttttaaggagcctgacgcagggcctggtgcttccctcaactcagcccagaagggagtaatgactaacctgatttttattatttcagggagttgctggggatgttgatccagccaagaatactgaggcagttggatgaaaggcttgggctctgcagttagagctgagtctgaatccagtcccatgatgggaccttggtctgctatagtcactgctatgtcaccagcatggaaaac

SEQ ID NO: 284561 - DNA, 502 bp, Homo sapiens
aggggaggagcctgctgttgccccagcaacaaccacggaaaccaagacgagcgcggtcgcggaagtatcgcggcttacatatctcgcagccaggcgggtcctgggagaggcgcgagccaggcctggtcggcgcccgcggagaaaagaagcagtcaagcccatgaactacaaccccggttgccgctttctcctctcctaaccgttaagtgcgctaagggccatggctgaggtgcacgtgatcgggcagatcatgggggccagcggtttctcggaaagtagcctcttctgcaagtggggcattcacacagggagttgctggggatgttgatccagccaagaatactgaggcagttggatgaaaggcttgggctctgcagttagagctgagtctgaatccagtcccatgatgggaccttggtctgctatagtcactgctatgtcaccagcatggaaaacagtgcttggcacatagcaggtgctgaataaatgttcatgaactcac

SEQ ID NO: 284562 - DNA, 913 bp, Homo sapiens
aggtaaggggcctggctgggcaccatggcggcaggtgggaaggtcgggctcgaggtgtgcggagaggaggccgcggaggggcagcagggctgtgcgttctgatgcgctcccctgcggggaccagagccggtgttcgagctgctgctgtctggcggctccggcagcttcttccgcttgtgcttccctttcctgcagccggccgaccgcgtctgcttggaagtagaatctcctggaaggataaaggacacagcgtttgtccccttcaaggaagtgatgttctctgagaagcacagacctggccctcgctagacactgaacctgccggtgccctgatcttggacttcctcgcctccaaaactgcaaatcaagaaatatgaaaagcagcaacacagggtcatgactttatgctcacgaatcacatacatgacgtctatgcagagagtgacagcccatggaaggagatccttggggctgccggctgactcaccaccaccattcgctgactcaccaccaccattcggttctgtgcgtgtccccgtcactggcttgaatgatgatttggtcattgactcaatgtagagctgctgacccagatttttaattttgttcacactggcatagacctgctgcaaggtcatcttagggaaaggaatgataaaatatgtttcaaaaattataaaaatgtccactaaaagatacataaacaaaatacacttagcttctgtttctttgaagatataatgactgaagcacagtaatcactttaatccagtttcctgcaccatgccacagtatactggtaccaacaaattctaaataaatctgttcacaatatgctaatttttagaacgcatacaattaattcaaatatcactttccaaaggtgatattttctttttacagactttttttt

SEQ ID NO: 284563 - DNA, 372 bp, Homo sapiens
acctgtggctcaccatcgtctcgtgtttttgccctgcgtaccccatcaacatcgtggctttggtcttttccatcatgtctctgaacagctacaacgacggagactacgaaggagccaggcggcttgggcggaatgctaagtgggtagccatcgcctccatcatcattggccttctcatcatcggcatttcttgtgcagttcacttcacaaggaatgcctgaggaaccagcggtcagtgggctgtgagcgtggaggatggacctcatccacacacaccccaaaggagtctctaaggaatggatccttgacttcagactgtgagatcttttcctccaggactctccagaggcaggtccctggcaaatgaacaag

SEQ ID NO: 284564 - DNA, 1377 bp, Homo sapiens
cgcgcagcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcacagccaggagcgcccacggagctggacccccagagccgcgcggccgccgcagcagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatattgatagtggacaaagtgctcgagacgcaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgtctggtcccagtaggtatcaggtctttctgtgcagctcagggagaccctaagttaaggggcagattaccaataaagaactgaatgaattcaaacccc

SEQ ID NO: 284565 - DNA, 1673 bp, Homo sapiens
cgcgcagcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcacagccaggagcgcccacggagctggacccccagagccgcgcggccgccgcagcagctttactcctgaagccagcgagatcacgaacccactgggagaaacgaacaactccagacgcactgccttaagagctgtaacactcactgcgaaggtccgcagctgcattcctgagccagcgagaccacaaacccaccagaaggaagaaacttcgaacgcatccgaacatcagaaggaacaaactccagacacgccgcctttaggaactgtaacactcaaccgcgagggtccgcggcttcattcttgaagtcagtgagaccaagaacccaccaattccggacacactgggattacagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatattgatagtggacaaagtgctcgagacgcaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgtctggtcccagtaggtatcaggtctttctgtgcagctcagggagaccctaagttaaggggcagattaccaataaagaactgaatgaattcaaacccc

SEQ ID NO: 284566 - DNA, 424 bp, Homo sapiens
gccagactctgaagtgcagcatcagctcctgcccaaccccttccagccaggccaggagcagctcgggtgagtagggtgggccgggggtgctttcagggagaagaccaggcccagggctgcagactcacctctcccgggctgattctccacttttctgacagacttctgcagagctacctaaagggactaggaaggacagaagtgcaactggagcatctgagccgggagcagggtgaggggctgggctgatggggccagggacgggaggctctgggcagccagatctgggactgacctcggctgccccattgactcctgccttctccacctcccccggcacctcttctaatccagcttctcttctctttagttctcctctacctctttgccctccatgactatgaccagagtggacagctggatg

SEQ ID NO: 284567 - DNA, 901 bp, Homo sapiens
cgcgcagcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcacagccaggagcgcccacggagctggacccccagagccgcgcggccgccgcagcagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggttctcctctacctctttgccctccatgactatgaccagagtggacagctggatggcctggagctgctgtccatgttgacagctgctctggcccctggagctgccaactctcctaccaccaacccggtaagctctgctggatggagatccccgcataaaggagacccagcactttggggctttggtctttctcatcataactcttttggccttacccaccctatattggagttggccccaattccaatatgtgttccagatcggacctccctgaggacagcaacactctgtatcctgggtcacatttgtggctgaggcacgcccttaattccaagggcaacctggacgccaggctggatggaggggagaaggcgatgcagccgcaatggtagtctccatggtgtgtgaggagccggcacctgctctcacacgatgccatcaaagccctgcaggccacacttcttgccggccacctggcacccgaatc

SEQ ID NO: 284568 - DNA, 1724 bp, Homo sapiens
cgcgcagcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcacagccaggagcgcccacggagctggacccccagagccgcgcggccgccgcagcagctttactcctgaagccagcgagatcacgaacccactgggagaaacgaacaactccagacgcactgccttaagagctgtaacactcactgcgaaggtccgcagctgcattcctgagccagcgagaccacaaacccaccagaaggaagaaacttcgaacgcatccgaacatcagaaggaacaaactccagacacgccgcctttaggaactgtaacactcaaccgcgagggtccgcggcttcattcttgaagtcagtgagaccaagaacccaccaattccggacacactgggattacaggtgtgaaccacaacacctggctctctttgttcctaattgaaattgccaaagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatattgatagtggacaaagtgctcgagacgcaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgtctggtcccagtaggtatcaggtctttctgtgcagctcagggagaccctaagttaaggggcagattaccaataaagaactgaatgaattcaaacccc

SEQ ID NO: 284569 - DNA, 2003 bp, Homo sapiens
gccccacgccacgcgtcgctggtcccaggcagcgagtcgctcgcgcgccccgccgcccgcctggcgacagctccgccgcgcacgcacatggaggggagcgcgagccccccggaaaagccccgcgcccgccctgcggctgccgtgctgtgccggggcccggtagagccgctggtcttcctggccaactttgccttggtcctgcagggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggtgctctcttttctgctgtggcctgtgtgaatagcctggccatgctgacggcctccggcatcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggagaggtcctgagagaggtgacacttcagggaccagaggcagcacgagggctggcatctctccttccagcccaaactgcacagccccaaccaggttcccaacacgtgtagcagtcatcagccattccttaacaatgaatgtggtacctggttagtgccagccttgggaaggagggagggaggtaagaggggcttggtgatctctggaggaagagtgttgcctttgctgtggttggggaatcgatccttggctatggcctacccactcccctggctgaagagtgccaatcattacaaatcagcttcagcaaactg

SEQ ID NO: 284570 - DNA, 1938 bp, Homo sapiens
  misc_feature (1307)..(1307): n is a, c, g, or t
aactttttaaaatttttatttgattgatgtatttagagacagggtctcgctttgttacccaggctagagtgcagtggcacgatcatggctcactgcagcctcatcccccgggcccagatgatcctcccaccttggcctctctagtagctgggaccactggtgcacattaccacaccttgctaatttttgtattttttatagagatggggtcctcaccattttgcccagtccaggtctctaactcctgagctcaaggatccgcctgcctcagcctcccaaagtgttgggattacaggcatgagccaccgtgcccggctttagttaactttttttaaagggacagatttattttgatagagccctaaaatgtgctgtgtatagtcaacaatacaataatcacagatttcttaactcaactgcttgtctgacaattaagcagaagggaacctttccctcctgctgatggccctgggggatgcagagatgataaagatgctgtcattgctctgggtcggggggaggtctcaacagagtgggatttgaggggcctgacactgctagggtccctggatgcctcatcgtataccttctttggaggatccactgtcctgtaggagtttgcagttttgctgaggagtcagcagtcgcacagggagagaaatggttatgaagaaaacaggaagcctgtaagtaactgaatgcaaagggaaaaggaactcccatttgctgtgtccctatgccatgctcttcatagatgttacctttttacctcatgtattggttccctgagattgctgtaatgacataccacaaacttgggggcttaacacaacagaaacatattctctcacagttctggaggccagaagtccaaagtcagtaccaccgggctgaatggaagcagtcagcaggcagtgctcccttgcaagcctccaggagagaacgtgtttctcatttcttccagcttctggggctgctggcattccttggcttggggcggccatcaccagtctctgcctctgtgctcacattgactctcctcctctttgtgccttctcaattctgtcggtgccaaatctccgtctgctttcctcttataaagatatgtgtgacggcatttagggcccaacctaatccaggataactctgctctctcaggaggcttaactgcacacctgcatagactcattttccaaataaggtagtatttacaggttccagggctatgaatctgatgccattgggcaccattattcagcctcctatgcctcagaaccatcctgtgatgaaggccttattatcttccncatacagggagtcaggatcagagagggtaagtaccccaggccacacagataatatgtaatggcatcaggttttgaactcagggctgactccaaagcccatgcttgttttctgtgccctgccatatccctactaagtgccaagtgggtgggtgatgcctgctgtgaccacaagaggttcagacaagaaagcaatcaatgggaattagcattcattcatgagagctagcaggtggccaagcccagacaagggcagtctccattcctccttgactactgtcttcccaccctcaccatcaaggaagttcttcctgggtctaacctaagccccacatggggtatggataggagctctgctgcctttcccttggacgcccctctccccagccccattttcctgatgagtgtttgtttctccacaggatatgggttgcttttcctgtcattagtcatcacacctgtcatccgggctaaactctccaagctggtgagagagacagagcagggtgagtgtcagaacccacctgtgtctggttcctcatgtccagtgctgcccgaaacgggctgatgggcagccatggctgggggaacagcttgccttcccccctctcaccctggagaagtaagtggccaa

SEQ ID NO: 284571 - DNA, 1343 bp, Homo sapiens
gccccacgccacgcgtcgctggtcccaggcagcgagtcgctcgcgcgccccgccgcccgcctggcgacagctccgccgcgcacgcacatggaggggagcgcgagccccccggaaaagccccgcgcccgccctgcggctgccgtgctgtgccggggcccggtagagccgctggtcttcctggccaactttgccttggtcctgcagggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggtaaagtgtgtgggctcagggacagcttgtcccagaggcactgggtaagaactgggggccggccactcactgcccccagatgtggttcattcctgtgtctttggaaacatagttatgcccccagcctgcactggagaacagacaactaagaaatccctcaaaaatgccatctttg

SEQ ID NO: 284572 - DNA, 2442 bp, Homo sapiens
tgtgacccggtgtgtatgattatttcctttggtgggttgtttctcttggtgggtttttgtctcctttgttgtgtcgcgcccgcgataggtgtggttgtgttccatatgttcttccgaccgggtcgcgtttctttcttgcctgcctcctcttctgttttgttggccccgctctcgttctccgtttttttcgccgcgccccgtgtggcggcccctgttctgacatcatctgggccgtggactgattgttgcgtcccctgtggggtgtgtatggggtcgcgcccctccgttgtcttgtttttgtttcttgtcttgtttgttgttttgtgttctgtgtttttttttttttttttttttttttttgttttttgtttttttttttgtttgtttttttttccacaactttttgagacatgttttgttagcaactccattttacagatgaaaaaacagaggctcagggtggtaagtggcatgccgaaggtagtggcagagcctaggtgttccagcccaggcagctgggctcagcccactccgatcctctccagctgcctctctgttacagcgcagaacatcagcagcatcaggagtcatgtgctcttccagctctgccttgagtacccgatgacctcgtttcctcagcggtagatagcgatggttaatattggctagcgaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggatatgggttgcttttcctgtcattagtcatcacacctgtcatccgggctaaactctccaagctggtgagagagacagagcagggtgctctcttttctgctgtggcctgtgtgaatagcctggccatgctgacggcctccggcatcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggagaggtcctgagagaggtgacacttcagggaccagaggcagcacgagggctggcatctctccttccagcccaaactgcacagccccaaccaggttcccaacacgtgtagcagtcatcagccattccttaacaatgaatgtggtacctggttagtgccagccttgggaaggagggagggaggtaagaggggcttggtgatctctggaggaagagtgttgcctttgctgtggttggggaatcgatccttggctatggcctacccactcccctggctgaagagtgccaatcattacaaatcagcttcagcaaactg

SEQ ID NO: 284573 - DNA, 2087 bp, Homo sapiens
gccccacgccacgcgtcgctggtcccaggcagcgagtcgctcgcgcgccccgccgcccgcctggcgacagctccgccgcgcacgcacatggaggggagcgcgagccccccggaaaagccccgcgcccgccctgcggctgccgtgctgtgccggggcccggtagagccgctggtcttcctggccaactttgccttggtcctgcagggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggatatgggttgcttttcctgtcattagtcatcacacctgtcatccgggctaaactctccaagctggtgagagagacagagcagggtgctctcttttctgctgtggcctgtgtgaatagcctggccatgctgacggcctccggcatcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggagaggtcctgagagaggtgacacttcagggaccagaggcagcacgagggctggcatctctccttccagcccaaactgcacagccccaaccaggttcccaacacgtgtagcagtcatcagccattccttaacaatgaatgtggtacctggttagtgccagccttgggaaggagggagggaggtaagaggggcttggtgatctctggaggaagagtgttgcctttgctgtggttggggaatcgatccttggctatggcctacccactcccctggctgaagagtgccaatcattacaaatcagcttcagcaaactg

SEQ ID NO: 284574 - DNA, 2388 bp, Homo sapiens
tgtgacccggtgtgtatgattatttcctttggtgggttgtttctcttggtgggtttttgtctcctttgttgtgtcgcgcccgcgataggtgtggttgtgttccatatgttcttccgaccgggtcgcgtttctttcttgcctgcctcctcttctgttttgttggccccgctctcgttctccgtttttttcgccgcgccccgtgtggcggcccctgttctgacatcatctgggccgtggactgattgttgcgtcccctgtggggtgtgtatggggtcgcgcccctccgttgtcttgtttttgtttcttgtcttgtttgttgttttgtgttctgtgtttttttttttttttttttttttttttgttttttgtttttttttttgtttgtttttttttccacaactttttgagacatgttttgttagcaactccattttacagatgaaaaaacagaggctcagggtggtaagtggcatgccgaaggtagtggcagagcctaggtgttccagcccaggcagctgggctcagcccactccgatcctctccagctgcctctctgttacagcgcagaacatcagcagcatcaggagtcatgtgctcttccagctctgccttgagtacccgatgacctcgtttcctcagcggtagatagcgatggttaatattggctagcgaagtggagacccttacctcccactggaccctctacatgaacgtgggcggcttcctggtggggctcttctcgtccaccctgctgggagcttggagcgacagtgtgggccgccgccctgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggatatgggttgcttttcctgtcattagtcatcacacctgtcatccgggctaaactctccaagctggtgagagagacagagcagggtgctctcttttctgctgtggcctgtgtgaatagcctggccatgctgacggcctccggcatcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggagaggtcctgagagaggtgacacttcagggaccagaggcagcacgagggctggcatctctccttccagcccaaactgcacagccccaaccaggttcccaacacgtgtagcagtcatcagccattccttaacaatgaatgtggtacctggttagtgccagccttgggaaggagggagggaggtaagaggggcttggtgatctctggaggaagagtgttgcctttgctgtggttggggaatcgatccttggctatggcctacccactcccctggctgaagagtgccaatcattacaaatcagcttcagcaaactg

SEQ ID NO: 284575 - DNA, 1138 bp, Homo sapiens
  misc_feature (1101)..(1101): n is a, c, g, or t
atttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaatcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactcaaaaaaaaaaanaaaataaaaaaaaacaggggggcgcacaaaaattacc

SEQ ID NO: 284576 - DNA, 982 bp, Homo sapiens
  misc_feature (861)..(861): n is a, c, g, or t
  misc_feature (871)..(871): n is a, c, g, or t
  misc_feature (885)..(885): n is a, c, g, or t
  misc_feature (891)..(891): n is a, c, g, or t
  misc_feature (893)..(893): n is a, c, g, or t
  misc_feature (901)..(902): n is a, c, g, or t
  misc_feature (905)..(905): n is a, c, g, or t
atttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggagatagggcgccgggacggatgtcccacccaggnaggggaaatngctccagaaaagangtgccncnaagattgnnccnaaacgggacacccgtgaggccaaggcgaagcacgaccggggagcccgaaagaggacacaaacgcggatagagagcga

SEQ ID NO: 284577 - DNA, 1127 bp, Homo sapiens
atttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactca

SEQ ID NO: 284578 - DNA, 1014 bp, Homo sapiens
atttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagtcccgtgctggggactgaataggcacggaaagaggctcgtgtcctaggatgccagccgatcagg

SEQ ID NO: 284579 - DNA, 990 bp, Homo sapiens
atttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggagtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatagtgccctacaacatcctacacccaaccccgacaagatgg

SEQ ID NO: 284580 - DNA, 903 bp, Homo sapiens
atttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactca

SEQ ID NO: 284581 - DNA, 163 bp, Homo sapiens
gggctgggggcctggattctaggatctcagggaggaggggttggggtctgggctcctggttcagtgggagaaggggctgggggtccaggatccagggcccctgagcctttccctgcctctcaggaccatggcagccgtgggctttgaggagttctcagcgccg

SEQ ID NO: 284582 - DNA, 804 bp, Homo sapiens
aggggtttggactgctggatctgacagactatgaggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactca

SEQ ID NO: 284583 - DNA, 1198 bp, Homo sapiens
atttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactca

SEQ ID NO: 284584 - DNA, 942 bp, Homo sapiens
  misc_feature (17)..(17): n is a, c, g, or t
  misc_feature (22)..(22): n is a, c, g, or t
  misc_feature (25)..(25): n is a, c, g, or t
  misc_feature (33)..(33): n is a, c, g, or t
  misc_feature (36)..(36): n is a, c, g, or t
  misc_feature (44)..(44): n is a, c, g, or t
  misc_feature (52)..(52): n is a, c, g, or t
  misc_feature (58)..(59): n is a, c, g, or t
  misc_feature (905)..(905): n is a, c, g, or t
gactaagggaacctacnaaagnttntggtcaanaanaacgcagngcgttgtntaatannacgacggcatactatacggtctaggtacgagctggtgggcggaatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactcaaaaaaaaaaanaaaataaaaaaaaacaggggggcgcacaaaaattacc

SEQ ID NO: 284585 - DNA, 483 bp, Homo sapiens
accaaataactaacattaaatgaaccacagcataaaatgagaaagcgccccactacaaacctctattcatttggaaaaagtaataaaatgtgtcttctgaataaccaatgaattaagtattgtataagtctacactcccttactgcaattccaaaatgcaaatgctcgactctgaccacactggtcatgttttctaatttcttataccttgttcatactctccattcttttaatttatgtaaagattttaaacatcttattctatattctgtattttataatattcaggatccacaatccttgagagctcaattcttccatcttttgtttctgatggctctcattatgtggcagcttatttccatgtggtctttgtaattttggattctgacttcatttttagcccaactccatctgtcagaagtcaggagcctgagatgaaaataagatcctttagagcaggggttgcaaaactttttatga

SEQ ID NO: 284586 - DNA, 807 bp, Homo sapiens
gcggaagggactagaccttccgcaactgagttcctgccagaccttggaccttaacttgcttctgacacagactttgctagaagcttccagagcagggctgagcacctacagatgactggagaacaccaaaggcaggccaggtgggaatggatggcgggaaaagccctgtgaatctcaaggcaccacacagggcacagagggagaccccaggtaacatgcacatggtcaaaaaatggaacaatatgaacaagatagtaagcaaagtcttactgcaatgcccttccagtttgccccagtaccagccctgcctcctccagatttcacatttcaagaaaatcctagcactcaccggtcggtagtaaaaatgtaccccacgtgatccttacagcttaacagcaggacactgaaggctacagcaaagagcactgaaggtaaaaacggcagaagaaacaacacagtgaacaagaagatccacaggaagtggaggagcctgggttttgcatgcagagactgcaccaagagcctcgggtaaaggggtctcagcacctgtaatcagcagggaaacggtagaggacttccgtgcctgctccatgtctccagcacccagagcgtttcctacccggacactggcagccacactgaagcctgcagggacctaaaataaaaaggaaacctgcaacaatgagtgagaaactgcagagcgagaacacgtgcagagaagcagcctcatgcctcacacctggtgggaaaacttggtcctaaaagttttgaaaagactgatttgcaacatcccctttgtctagccgg

SEQ ID NO: 284587 - DNA, 972 bp, Homo sapiens
gtgattggggtttacagtgttttctctcgctctctctgtttctagggaattcgggctgtgtttagctgctggaatatcgtagaattggttttcagagaagttcctcgactcctgaggcgaaacataaagggatgggagtggtgtgggaagtgatcgtgtggggaaaaaaaagtttcgagcccgtttcgcatttgtggagacagagtttttggtgtgaccactcttttgtgggaaacccaaaccaaggagaactcaggagaattggcgctcttcggtcctggaggttccgcagctaacatcccggcttgaccaactatcgaggccgcaaattaatagggcacctcctgggaggaaaacgcccatcctgacttctcaactgtgacagtttgctctgtcgcccaggatggagtgcagtgcagtggcgcgatcctgcaacctccgcctctcgagttcaagcgattctcctgcctcagcctcccgagtagctgggattacagacgcgcgccaccccacccagatgatctttttaaatgcaaaatgccatcgacgcagaaaatcaaaggtatccattgtatctgtgcgtttgagttctaggatatgacaaagaaaaacaatttaaatattacgtaaattcagtaggaaaaagaaagatgatgactgataagtacattgtgtacctccttaagctgtgctgtccagtaggctgtcctctagccatatgtggctactcagcacttgaaatgtggttgagacggaaaaactgaatcgttaattgaatttgaattaaacaaaaaccaaaaacctgatgctcgattcaattgttggaatacttttaagtgtgtttgcaacaactcagatatatgaatctgtttttccaacttaaattttatgaactctaactttagcatatgaattgagatgtgctgtaagtatatatcagctggactttttttttatttctggacttactac

SEQ ID NO: 284588 - DNA, 1195 bp, Homo sapiens
gtgattggggtttacagtgttttctctcgctctctctgtttctagggaattcgggctgtgtttagctgctggaatatcgtagaattggttttcagagaagttcctcgactcctgaggcgaaacataaagggatgggagtggtgtgggaagtgatcgtgtggggaaaaaaaagtttcgagcccgtttcgcatttgtggagacagagtttttggtgtgaccactcttttgtgggaaacccaaaccaaggagaactcaggagaattggcgctcttcggtcctggaggttccgcagctaacatcccggcttgaccaactatcgaggccgcaaattaatagggcacctcctgggaggaaaacgcccatcctgacttctcaactgtgacagtttgctctgtcgcccaggatggagtgcagtgcagtggcgcgatcctgcaacctccgcctctcgagttcaagcgattctcctgcctcagcctcccgagtagctgggattacagacgcgcgccaccccacccagatgatctttttaaatgcaaaatgccatcgacgcagaaaatcaaagaatcagcttaagttccagaaaaaagaaaaaccaaccaaatgaacaataagacaacaacaacaacaacaaaaaaggccttttgggattttggatgatattgcatcaaatccatacattaacctgagagacgagcgacttcttcaacattgagccttccaatcatgattttcaattcatttaggtcttctgtaatgtttcttaatataattgtatttgttgctatgcagaagtttcactgatcttttattatatctctatatatatttgatatttctgacactattgtaaatagtatctttttaatatttcattttccttttttgttgcttaaatatatataaaataagctaattttccaaactaatttttatatccagcaaccctgctaaaatttcttatccaataaaaatataaatgtaaaaaaacaaaggaaaagctcgaggtcagcatgtggcgcctcgcgtggaaggggttgcacttcctggggccggccgggggcggggtgttgggcctgttcttgtaagggtggggatggtgacccactcttccttttgttgtagtgcctatgagctcgtgaaataaggcggaggctttggggggtgggcgaggcgataggagaacacagaaagagga

SEQ ID NO: 284589 - DNA, 1016 bp, Homo sapiens
ggagagagggatgggcgtggctaatatgaaagctgcatctttactagttagctaccatgcgtcattatttatcaaaagatatatgctgcttaaacacaaatacgttttaaaatatattttaggcagtagggttttgggttttttttttgcaagttcttttggtgagtaaatttagtgataaatgatttttttttcttttgagacagtttgctctgtcgcccaggatggagtgcagtgcagtggcgcgatcctgcaacctccgcctctcgagttcaagcgattctcctgcctcagcctcccgagtagctgggattacagacgcgcgccaccccacccagatgatctttttaaatgcaaaatgccatcgacgcagaaaatcaaagaatcagcttaagttccagaaaaaagaaaaaccaaccaaatgaacaataagacaacaacaacaacaacaaaaaaggccttttgggattttggatgatattgcatcaaatccatacattaacctgagagacgagcgacttcttcaacattgagccttccaatcatgattttcaattcatttaggtcttctgtaatgtttcttaatataattgtatttgttgctatgcagaagtttcactgatcttttattatatctctatatatatttgatatttctgacactattgtaaatagtatctttttaatatttcattttccttttttgttgcttaaatatatataaaataagctaattttccaaactaatttttatatccagcaaccctgctaaaatttcttatccaataaaaatataaatgtaaaaaaacaaaggaaaagctcgaggtcagcatgtggcgcctcgcgtggaaggggttgcacttcctggggccggccgggggcggggtgttgggcctgttcttgtaagggtggggatggtgacccactcttccttttgttgtagtgcctatgagctcgtgaaataaggcggaggctttggggggtgggcgaggcgataggagaacacagaaagagga

SEQ ID NO: 284590 - DNA, 854 bp, Homo sapiens
ctctagcaggtcagaacatgggtgggtgggagaatagtaattcgtttgctctgtcgcccaggatggagtgcagtgcagtggcgcgatcctgcaacctccgcctctcgagttcaagcgattctcctgcctcagcctcccgagtagctgggattacagacgcgcgccaccccacccagatgatctttttaaatgcaaaatgccatcgacgcagaaaatcaaagaatcagcttaagttccagaaaaaagaaaaaccaaccaaatgaacaataagacaacaacaacaacaacaaaaaaggccttttgggattttggatgatattgcatcaaatccatacattaacctgagagacgagcgacttcttcaacattgagccttccaatcatgattttcaattcatttaggtcttctgtaatgtttcttaatataattgtatttgttgctatgcagaagtttcactgatcttttattatatctctatatatatttgatatttctgacactattgtaaatagtatctttttaatatttcattttccttttttgttgcttaaatatatataaaataagctaattttccaaactaatttttatatccagcaaccctgctaaaatttcttatccaataaaaatataaatgtaaaaaaacaaaggaaaagctcgaggtcagcatgtggcgcctcgcgtggaaggggttgcacttcctggggccggccgggggcggggtgttgggcctgttcttgtaagggtggggatggtgacccactcttccttttgttgtagtgcctatgagctcgtgaaataaggcggaggctttggggggtgggcgaggcgataggagaacacagaaagagga

SEQ ID NO: 284591 - DNA, 208 bp, Homo sapiens
gagacactggtctggatcgggtcggtggagtgggggacttacatccgtgatggccttcttggccttctcctcagcattcctgcactcctgcactgcctcctccacttcagtctggagctgggacaggaatgagcaggggagctgctcacctgggaatgcagcagctgcacccgctcactagtctcaatcagctcctgctccgccagct

SEQ ID NO: 284592 - DNA, 978 bp, Homo sapiens
  misc_feature (973)..(977): n is a, c, g, or t
aggcctaaagaggtagtgggtgtgagccagcctcgggcgcgttaaaaagggggcgccggagggaggcaaggagaggaagttgggtgtaggaagaagcgagaggaaactgttgcctggacagagcgtgccgtgccaaagcgcggaaacgggatcaaggagggggcatcaggaatcgcctggggaccccccggagagtggcggaagcggtgcccttgggcgcagcaaagagagaagggagcacaggctgagatagagacagtcctgggcgctggagagcaggagcccccggagcggcagggaaaggaacgtagagcctgcatgctcggggtatgagcttactgcgctcgctagggtggcgcgcactggggctctagaaaagagggttgagaagccccgggcaagtgcctaggaaggtcagaggagtcagcaaagtccacggaagaacttccccgggttggagaggaaacgcaccctgggagctggaaagaagaggaaagctagcctgggggaagcttgatcagggctctgagtaccacgaggagtgcagaggaggtgctgatgattgcggggagagctctgagagcccgagaaagatggggaaactgaagccctagaggaaaagaagactaaatgtattaccatctgacccacttcctggccagcctgttcacctgtctgctgttcttcattgtggcaggtgtatgtgtgagtttgcagctcaatcctggccaaggggatccaaggactgctgaagaggcatgtctgcacatgtcacctagaacatctccagccatcatgtgatctctgggggaggcattcccaactctctgagagaagcagaccagaaagatggaaagaaagcacctggctccaggatgatgacattgagccgatgaattaaccacctttgtgctgctctaaccttcagagttcaccttaacatgagaaaataaaacccttattgcttaaacannnnna

SEQ ID NO: 284593 - DNA, 1039 bp, Homo sapiens
  misc_feature (1034)..(1038): n is a, c, g, or t
aggcctaaagaggtagtgggtgtgagccagcctcgggcgcgttaaaaagggggcgccggagggaggcaaggagaggaagttgggtgtaggaagaagcgagaggaaactgttgcctggacagagcgtgccgtgccaaagcgcggaaacgggatcaaggagggggcatcaggaatcgcctggggaccccccggagagtggcggaagcggtgcccttgggcgcagcaaagagagaagggagcacaggctgagatagagacagtcctgggcgctggagagcaggagcccccggagcggcagggaaaggaacgtagagcctgcatgctcggggtatgagcttactgcgctcgctagggtggcgcgcactggggctctagaaaagagggttgagaagccccgggcaagtgcctaggaaggtcagaggagtcagcaaagtccacggaagaacttccccgggttggagaggaaacgcaccctgggagctggaaagaagaggaaagctagcctgggggaagcttgatcagggctctgagtaccacgaggagtgcagaggaggtgctgatgattgcggggagagctctgagagcccgagaaagatggggaaactgaagccctagaggaaaagaagactaaatgtattaccatctgacccacttcctggccagcctgttcacctgtctgctgttcttcattgaacaagagaaggaatcacaattggtccatgacagtcacggtcatctcattcctcttgccagtggcaggtgtatgtgtgagtttgcagctcaatcctggccaaggggatccaaggactgctgaagaggcatgtctgcacatgtcacctagaacatctccagccatcatgtgatctctgggggaggcattcccaactctctgagagaagcagaccagaaagatggaaagaaagcacctggctccaggatgatgacattgagccgatgaattaaccacctttgtgctgctctaaccttcagagttcaccttaacatgagaaaataaaacccttattgcttaaacannnnna

SEQ ID NO: 284594 - DNA, 909 bp, Homo sapiens
aggcctaaagaggtagtgggtgtgagccagcctcgggcgcgttaaaaagggggcgccggagggaggcaaggagaggaagttgggtgtaggaagaagcgagaggaaactgttgcctggacagagcgtgccgtgccaaagcgcggaaacgggatcaaggagggggcatcaggaatcgcctggggaccccccggagagtggcggaagcggtgcccttgggcgcagcaaagagagaagggagcacaggctgagatagagacagtcctgggcgctggagagcaggagcccccggagcggcagggaaaggaacgtagagcctgcatgctcggggtatgagcttactgcgctcgctagggtggcgcgcactggggctctagaaaagagggttgagaagccccgggcaagtgcctaggaaggtcagaggagtcagcaaagtccacggaagaacttccccgggttggagaggaaacgcaccctgggagctggaaagaagaggaaagctagcctgggggaagcttgatcagggctctgagtaccacgaggagtgcagaggaggtgctgatgattgcggggagagctctgagagcccgagaaaggtgaggaggaggtgcgaggacaaagaacacctagcgcgggccgggccgtgaggaagggagccgcagagagcgcgcggactcccctgcaggggctcaaagccgcccgggtctctcctcccaggctgcctctggccgtgattcactcaccatgatggaaaagaccaaagccacgatgttgatggggtacgcagggcaaaaacacgagacgatggtgagtcgaatggtggtcctagggcttcgtgaggtctttacctcgtgccgagggtacggggctcgaattgggaagtcatgcgcatagttgtcccagtatgagctt

SEQ ID NO: 284595 - DNA, 483 bp, Homo sapiens
  misc_feature (478)..(482): n is a, c, g, or t
ctctctgcttcaccaacagatgtgcaatctaagactcagagaagctggagaattttcctaacgtcacacagcaaaggaatggaagactcaggacaagaatacacgatcctctccttccaacatgtcacccagcagaacaagagaaggaatcacaattggtccatgacagtcacggtcatctcattcctcttgccagtggcaggtgtatgtgtgagtttgcagctcaatcctggccaaggggatccaaggactgctgaagaggcatgtctgcacatgtcacctagaacatctccagccatcatgtgatctctgggggaggcattcccaactctctgagagaagcagaccagaaagatggaaagaaagcacctggctccaggatgatgacattgagccgatgaattaaccacctttgtgctgctctaaccttcagagttcaccttaacatgagaaaataaaacccttattgcttaaacannnnna

SEQ ID NO: 284596 - DNA, 496 bp, Homo sapiens
aggttaaaatgaagcgattcagtcaagatacgtgtggcgcacatgatcctgcagaggtggaagcccacgccaagatattctggcagcacctaccctgacttccatattacacagaaagttgtcagcctgggtgaagaaggaaccagggcacccaactcatctgactgaaaaacaaaacaccacaagaggaatcccaagacctaaccaaaagataatctagactatgagctttgtcaattccaattggaatgtcgtggtcttctccttcgcccacagtgaatgccacatctctgcagtcaaacatccttccaccacagcggccttccaggtggactgagggcaaggagacaggagagtcaacagagctgcttcttaggactggctaattcagtgaagtgataaatgagtggtcgacaatgtagcaaataccatttcccctttctcatttcatcaagagacacacacagtgtgtcttggtgaagcttagtctacccag

SEQ ID NO: 284597 - DNA, 1307 bp, Homo sapiens
caggcgcccgccactgcgcccggctaattttttgtatttttagtagagagggggtttcaccgtggtctcgatctcctgacctcgtgatccgcccgcctcagcctcccaaagtgctgggattacaggcgtgagccaccgcgcccggccagttcaatggattttaaaaattattattctctagaaaaaagaccacgaactttggagtggacatcctgagacctgcctacgaagaccattaggtggcctccagaagacactcccctgattcctacaccgagggaacacacagcagcaagctaggaaagaaggggtgacccagcccaacgctgtaaaccagggcgcgaaccggcgttgagctgtgcagctgcgccctgggctccagtcctgctctgccgcagaccccaccggagccagcacctgcctccccgaccctcgctggggcggctgtgagatgagcccagagccttcctgagccaaccctcgcaaggaaagtctgtctgttcaccccactatccttgtcttgaaggatgaagaaaagagggccccccgggaggtcccaaaaggtggaatggacatctgggatccaagcacagcaatttctttatttttcttaagcctctcactagaggatgaaaatcgttctgcataaaggcctgggctttatgaaaaatatattcacacctcccgtgtccgagctgggataccaaagaagttcctggttgagtactacttatgaatgaaggattcaggggatgcacaggacacagaggaatctgggggatattatggttctgggaatgtggaatgtaacgtctcatcttcagcccatctgtgctactgatcatctcattccagaagccatgccttctctcaggagcagacagcacaagactttcctgccagaggcacagtccccaggtgagccacacagccttcacagggtaatgccaaagaacagaggagagttcctgctactctccgggtcttcttggcaaagcttctgatacagtctggctgtctctccacctgaatctcatcttgaattgtagctcccataattctcgtatgtcatgggagggatcaggtgagaggtaactgaatcatgggggtgggtctttcctgtgccgttctcgtgacagtgaataagttttatgagatctgatggttttataaaggggagttcccctgcaaatgttcttgcctgctgtgactttgctcctccttgccttccgccgtgattgtgaggcctccccagttatgtggaactgtgagtccattaaacctctttttctttataaattacctag

SEQ ID NO: 284598 - DNA, 1577 bp, Homo sapiens
gcggccgcaagccccgagccccaaggccggccgcgcagcgccgcgtcccgccctccccgctccgcggccggcccgggcgatgcggacacaaaggggacgcgcgtcactctacctgggcctgctcgtccgcggtgcgcggctctgacgcctccgcccggtactggctgcggggtgccgggtgcccgcagtttgccgcccgcgcctccccgcgcccgcgcagcccgcacggcccgcactgcaatgccagccctgccgcctcccgcctgccgagagcccgcgcggggagaagcggctgcgcgggcggggcgcgagcgcgcacagaggccgggcacgcgggaggctcggccccggccccgcccccgcgccgagccgcacagcgccccctgccgcccgcctgcgccggcccgaggcccggagccgccccgcaggccccaggacaggctccggcacgaggaggggctgcggagaccgcccgtgcacgctaacatgaaaatgctattcctgctttagtggcctccagaagacactcccctgattcctacaccgagggaacacacagcagcaagctaggaaagaaggggtgacccagcccaacgctgtaaaccagggcgcgaaccggcgttgagctgtgcagctgcgccctgggctccagtcctgctctgccgcagaccccaccggagccagcacctgcctccccgaccctcgctggggcggctgtgagatgagcccagagccttcctgagccaaccctcgcaaggaaagtctgtctgttcaccccactatccttgtcttgaaggatgaagaaaagagggccccccgggaggtcccaaaaggtggaatggacatctgggatccaagcacagcaatttctttatttttcttaagcctctcactagaggatgaaaatcgttctgcataaaggcctgggctttatgaaaaatatattcacacctcccgtgtccgagctgggataccaaagaagttcctggttgagtactacttatgaatgaaggattcaggggatgcacaggacacagaggaatctgggggatattatggttctgggaatgtggaatgtaacgtctcatcttcagcccatctgtgctactgatcatctcattccagaagccatgccttctctcaggagcagacagcacaagactttcctgccagaggcacagtccccaggtgagccacacagccttcacagggtaatgccaaagaacagaggagagttcctgctactctccgggtcttcttggcaaagcttctgatacagtctggctgtctctccacctgaatctcatcttgaattgtagctcccataattctcgtatgtcatgggagggatcaggtgagaggtaactgaatcatgggggtgggtctttcctgtgccgttctcgtgacagtgaataagttttatgagatctgatggttttataaaggggagttcccctgcaaatgttcttgcctgctgtgactttgctcctccttgccttccgccgtgattgtgaggcctccccagttatgtggaactgtgagtccattaaacctctttttctttataaattacctag

SEQ ID NO: 284599 - DNA, 607 bp, Homo sapiens
taattatatggttggatagatattatcacctatgaatttcatctcaggatagtaaacggtacaaaatatttctgaaagtatgcgtatcaaaaatgtttaacctggattggtgcagtggctcacgcctgtaattccaccactttgagaggctgaggcaggaggatcacttgaggccaggagttcaagaccagcctgggcaacgtggtgagaccctgcctttaaaaaaacaaaaaagtttaacctgaatctaatcaggcttttataacaaatgtccaatttatgggaaacaaaggaacaagtgaaaagatacataatgaccttatatatcttatataaaaaacaacctatgggaaaaatagtctccttaacaagacttctatcatgagacagaggggaatatactaagaatacgtccaaagccccacatgctatgctaagcctagagattacaaagatgaataagtcagttcctgtcctcaagtaacctactgagaaatctattcaatacttgaatattataaaactaaacttttcagacttcctctttctgtaaaggacacaaaaatagcagcaaaaagataataataaagtattgctagtaccattt

SEQ ID NO: 284600 - DNA, 1287 bp, Homo sapiens
cgtagtaacagaagctagataacagaggcttctggagtgagtaggcagtgagaaaatggaggtggtaaaagaggggaaaactagaacaaatagtcaagtaaagatttttgttttgttttaatgtactaaaagtaaccagtatagtgcttatgctttttcctgttattcttttgtggtttttcaatagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggttgcagtgagccgagattatgccactgtactccagcgtgggtgacagagtgagactctgtctcaaattaa

SEQ ID NO: 284601 - DNA, 1305 bp, Homo sapiens
tttggaggcaaggtctcactctgtcacctggctggagtgcagtggcaggatctcagctcaagtgatcctcccatctcaacctcctgattagctgagactacaggcgctaccatgcctcatttttctatttttggtagattgctcaggctggtctgaaactcctaggctcaagcgatccacctaccttggcctcccaaagtgttgagattgcaagtgtgagcctctgcacctggccaaaactatgtaattcattttgcatttacagcagttatattttgtaggaaatgaaaaaccacatgcaataaaaaccaaaatgaaaaaaaaaatagttaggcttatatttatttactcatgccaaaataccccttatgtattctttcatgttttttagtacatggagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggttgcagtgagccgagattatgccactgtactccagcgtgggtgacagagtgagactctgtctcaaattaa

SEQ ID NO: 284602 - DNA, 531 bp, Homo sapiens
cgtagtaacagaagctagataacagaggcttctggagtgagtaggcagtgagaaaatggaggtggtaaaagaggggaaaactagaacaaatagtcaagtaaagatttttgttttgttttaatgtactaaaagtaaccagtatagtgcttatgctttttcctgttattcttttgtggtttttcaatagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataaggtatgaattaatgtacttctgcatttctagtcactaccccagagaagacaatggtgaagtaatccacagaaatgtttatagctcatgtcaacaggatttgttcttccccattttggaagtagattcaaagcattggctgaatggtattgtaccaagat

SEQ ID NO: 284603 - DNA, 1675 bp, Homo sapiens
ccggctactgcgggtcctgggtcttcacctgcggagccttacggcagctgagcggtgggagggacctgagccgcggcgctaggatgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggttgcagtgagccgagattatgccactgtactccagcgtgggtgacagagtgagactctgtctcaaattaa

SEQ ID NO: 284604 - DNA, 984 bp, Homo sapiens
gatcttttggaggagaggcagactctgcttagaacaggtggtttgtgttccctggttctcttgagaagggggaccacccataccagtctgtcttaacattttcttcctttctttctttcccctaataacagccagttttgggactgttaccccaaaaaagtttactattaaagctcaatatgaagccagcgaggtgaaattttagggattttagatgtatctgaagctacttctcagcaatatctccccagcctcatccttttcctgttgtctctttatttccagaaggcactggtgttattaaaattgtgtgttggaaggtgtttttctgttttctggaatcttctttctctggaaaatcatatgtaattgctttgtgaagtcttactttgttttctctcagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaagtgaggggtgaatttaaggctgagtattgcagacataagtttatttcgtgtaaaaatgtagttttctatttttttcagtaaaatactcccttagtatccatcagctactcgttaatgtgtttttttctcattggcatgtatcaataacaaagccttccaaggaggacaggagcccttataagactgactagggttcagatttgccaagcagtgtctgagaacaactcatcaaggattgtggggagagaagagaaggagacaaagat

SEQ ID NO: 284605 - DNA, 717 bp, Homo sapiens
gctaggaaagctcatctggcctcctgctcatctggcctcctgttccagtgcttccaggggatccacgttcagaagctgactctgcaggcaagaccgacgttattttcctggtggctgtgttcaaaaccacccaaagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaagtgaggggtgaatttaaggctgagtattgcagacataagtttatttcgtgtaaaaatgtagttttctatttttttcagtaaaatactcccttagtatccatcagctactcgttaatgtgtttttttctcattggcatgtatcaataacaaagccttccaaggaggacaggagcccttataagactgactagggttcagatttgccaagcagtgtctgagaacaactcatcaaggattgtggggagagaagagaaggagacaaagat

SEQ ID NO: 284606 - DNA, 786 bp, Homo sapiens
gctaggaaagctcatctggcctcctgctcatctggcctcctgttccagtgcttccaggggatccacgttcagaagctgactctgcaggcaagaccgacgttattttcctggtggctgtgttcaaaaccacccaaagggtttgagaaatactttaagaggagtggaaggaacacaaactgagaaacatcaacagcaccaaaaaaagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaagtgaggggtgaatttaaggctgagtattgcagacataagtttatttcgtgtaaaaatgtagttttctatttttttcagtaaaatactcccttagtatccatcagctactcgttaatgtgtttttttctcattggcatgtatcaataacaaagccttccaaggaggacaggagcccttataagactgactagggttcagatttgccaagcagtgtctgagaacaactcatcaaggattgtggggagagaagagaaggagacaaagat

SEQ ID NO: 284607 - DNA, 909 bp, Homo sapiens
gcgcgcgcccgggcggcgcgggatctgggtctggggatgtggtaccggctgctggcggcggccggcagtagagcggtggccaggccgctggccttgctgtggcgatgtggtggcccaggaggcggcaggacggccaagaccagcgcgagggccctgggcaaggcccgacagtgcttccaggggatccacgttcagaagctgactctgcaggcaagaccgacgttattttcctggtggctgtgttcaaaaccacccaaagggtttgagaaatactttaagaggagtggaaggaacacaaactgagaaacatcaacagcaccaaaaaaagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaagtgaggggtgaatttaaggctgagtattgcagacataagtttatttcgtgtaaaaatgtagttttctatttttttcagtaaaatactcccttagtatccatcagctactcgttaatgtgtttttttctcattggcatgtatcaataacaaagccttccaaggaggacaggagcccttataagactgactagggttcagatttgccaagcagtgtctgagaacaactcatcaaggattgtggggagagaagagaaggagacaaagat

SEQ ID NO: 284608 - DNA, 713 bp, Homo sapiens
gcgcgcgcccgggcggcgcgggatctgggtctggggatgtggtaccggctgctggcggcggccggcagtagagcggtggccaggccgctggccttgctgtggcgatgtggtggcccaggaggcggcaggacggccaagaccagcgcgagggccctgggcaaggcccgacagtggttatggccagtgagaatgtgcggtgttgcattgcagaagaagctaggaaagctcatctggcctcctgttccagtgcttccaggggatccacgttcagaagctgactctgcaggcaagaccgacgttattttcctggtggctgtgttcaaaaccacccaaagggtttgagaaatactttaagaggagtggaaggaacacaaactgagaaacatcaacagcaccaaaaaaagagtctcactctgtcacccaggctggagtgcagtggcacaatctcggctcactgcaagctctgcctcctgggttcacgccattctcctccttctcctgcctcagcctcccgagtagctgggactacagccgcccgccaccatgcccgggtaatttttttgtatttttagtagagacgggttttcaccgtgttagccaggatggtctcgatatcctgacctcgtgatctgcccgcctgggcctcccaaagggctgggattacaggcatgagccactgcacccggccaaggaatgtttctttgaagactcat

SEQ ID NO: 284609 - DNA, 2248 bp, Homo sapiens
gatcttttggaggagaggcagactctgcttagaacaggtggtttgtgttccctggttctcttgagaagggggaccacccataccagtctgtcttaacattttcttcctttctttctttcccctaataacagccagttttgggactgttaccccaaaaaagtttactattaaagctcaatatgaagccagcgaggtgaaattttagggattttagatgtatctgaagctacttctcagcaatatctccccagcctcatccttttcctgttgtctctttatttccagaaggcactggtgttattaaaattgtgtgttggaaggtgtttttctgttttctggaatcttctttctctggaaaatcatatgtaattgctttgtgaagtcttactttgttttctctcagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaaacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagtgctcaccccaggcttccctgacggggatgactcagcactacccctcaacagagatgactttgatgactctgcccctcagcagggcttactaagcactaccccttaacagggatgactccgcactgcccctcaacagggatgactcagcagagatgactcagcactgtcccttagcagggatgacacagcaaggatgattcagcactgcccctcagcaaggatgactcagcactgccgctcaacagacatgactcagggatggcttagtactgcccctcagcagggatgactcagcaccgcctctcaacagggatgactcagcagggatgactcagcaccgcccctcaacaggcatgactctgcagagatgactcagcactgtcccttagcagggatgacacagcaaggatgactcagcactgcccctcagcaaggatgactcagcactgccgctcaacagggatgactcagggatggcttagtactgcccctcaacagggatgactcagcagggatgactcagcaccacccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggttaacaaaaaatgtgg

SEQ ID NO: 284610 - DNA, 2249 bp, Homo sapiens
gcgcgcgcccgggcggcgcgggatctgggtctggggatgtggtaccggctgctggcggcggccggcagtagagcggtggccaggccgctggccttgctgtggcgatgtggtggcccaggaggcggcaggacggccaagaccagcgcgagggccctgggcaaggcccgacagtggttatggccagtgagaatgtgcggtgttgcattgcagaagaagctaggaaagctcatctggcctcctgttccagtgcttccaggggatccacgttcagaagctgactctgcaggcaagaccgacgttattttcctggtggctgtgttcaaaaccacccaaagggtttgagaaatactttaagaggagtggaaggaacacaaactgagaaacatcaacagcaccaaaaaaagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaaacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagtgctcaccccaggcttccctgacggggatgactcagcactacccctcaacagagatgactttgatgactctgcccctcagcagggcttactaagcactaccccttaacagggatgactccgcactgcccctcaacagggatgactcagcagagatgactcagcactgtcccttagcagggatgacacagcaaggatgattcagcactgcccctcagcaaggatgactcagcactgccgctcaacagacatgactcagggatggcttagtactgcccctcagcagggatgactcagcaccgcctctcaacagggatgactcagcagggatgactcagcaccgcccctcaacaggcatgactctgcagagatgactcagcactgtcccttagcagggatgacacagcaaggatgactcagcactgcccctcagcaaggatgactcagcactgccgctcaacagggatgactcagggatggcttagtactgcccctcaacagggatgactcagcagggatgactcagcaccacccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggttaacaaaaaatgtgg

SEQ ID NO: 284611 - DNA, 2116 bp, Homo sapiens
gatcttttggaggagaggcagactctgcttagaacaggtggtttgtgttccctggttctcttgagaagggggaccacccataccagtctgtcttaacattttcttcctttctttctttcccctaataacagccagttttgggactgttaccccaaaaaagtttactattaaagctcaatatgaagccagcgaggtgaaattttagggattttagatgtatctgaagctacttctcagcaatatctccccagcctcatccttttcctgttgtctctttatttccagaaggcactggtgttattaaaattgtgtgttggaaggtgtttttctgttttctggaatcttctttctctggaaaatcatatgtaattgctttgtgaagtcttactttgttttctctcagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaaacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagtgctcaccccaggcttccctgacggggatgactcagcactacccctcaacagagatgactttgatgactctgcccctcagcagggcttactaagcactaccccttaacagggatgactccgcactgcccctcaacagggatgactcagcagagatgactcagcactgtcccttagcagggatgacacagcaaggatgattcagcactgcccctcagcaaggatgactcagcactgccgctcaacagacatgactcagggatggcttagtactgcccctcagcagggatgactcagcaccgcccctcaacagggatgactcagcagactcagcagggatgactcagcactgcccctcaacagacatgactcagcagggacagggatgactcagcaccacccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggttaacaaaaaatgtgg

SEQ ID NO: 284612 - DNA, 2036 bp, Homo sapiens
  misc_feature (3)..(3): n is a, c, g, or t
ggnccctgggccaaggccccgacaagttggttatggccagtgagaatgtgcggtgttgcattgcagaagaagctaggaaagctcatctggcctcctgttccagtgcttccaggggatccacgttcagaagctgactctgcaggcaagaccgacgttattttcctggtggctgtgttcaaaaccacccaaagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaaacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagtgctcaccccaggcttccctgacggggatgactcagcactacccctcaacagagatgactttgatgactctgcccctcagcagggcttactaagcactaccccttaacagggatgactccgcactgcccctcaacagggatgactcagcagagatgactcagcactgtcccttagcagggatgacacagcaaggatgattcagcactgcccctcagcaaggatgactcagcactgccgctcaacagacatgactcagggatggcttagtactgcccctcagcagggatgactcagcaccgcctctcaacagggatgactcagcagggatgactcagcaccgcccctcaacaggcatgactctgcagagatgactcagcactgtcccttagcagggatgacacagcaaggatgactcagcactgcccctcagcaaggatgactcagcactgccgctcaacagggatgactcagggatggcttagtactgcccctcaacagggatgactcagcagggatgactcagcaccacccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggttaacaaaaaatgtgg

SEQ ID NO: 284613 - DNA, 1601 bp, Homo sapiens
agggggcctcttcggtgttggtgagacagcagccaagatcttaaaaagcaacatcgatgtgttatttgcagacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagtgctcaccccaggcttccctgacggggatgactcagcactacccctcaacagagatgactttgatgactctgcccctcagcagggcttactaagcactaccccttaacagggatgactccgcactgcccctcaacagggatgactcagcagagatgactcagcactgtcccttagcagggatgacacagcaaggatgattcagcactgcccctcagcaaggatgactcagcactgccgctcaacagacatgactcagggatggcttagtactgcccctcagcagggatgactcagcaccgcctctcaacagggatgactcagcagggatgactcagcaccgcccctcaacaggcatgactctgcagagatgactcagcactgtcccttagcagggatgacacagcaaggatgactcagcactgcccctcagcaaggatgactcagcactgccgctcaacagggatgactcagggatggcttagtactgcccctcaacagggatgactcagcagggatgactcagcaccacccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggttaacaaaaaatgtgg

SEQ ID NO: 284614 - DNA, 1784 bp, Homo sapiens
agtgttcagaggcctcagagatcagtttcttagccccaaaactaatttgtacccacttgaatttctgtcttaattaaagtcagacttagtgagtcttactgcagagctgacagtaatgtcccagggggagaatctggcaacctgatgcttcccgcagcgtttctgcctggggcttgccctccctgctgaggaagctcgtttgcttttctctcttcttttcaatgaaatcctggtctatgctaggaaacctacttccctgcctaggcgggatcaccctcaggaatgagtggggacttttccagggagatgcctgttcttttcacccatgctccgcagctctttgctgcgtcagtacctcatggttatgtggccattggccacggcttctgacctatgcccgccggctcctgccacccctggaacattctgctgtggcatcttatcacctccagctgccttggcgcccccagtggtacccgtcccctggctccccacagtgtcctgcctagtgtcaggtcacgtgtattcacacaggattgtacgtttgcctgctgcaggatggtgagtgaggtcttggctggcaggtatctgaaaggtgtcatctgtcttagacacaaaatgtgcttcctcccttttgttctctcctctggctgacttcagatgtctgtttacataccaaagttaaaaagctggaatgttaccaagactgctttcttctgcccatagacggggatgactcagcactacccctcaacagagatgactttgatgactctgcccctcagcagggcttactaagcactaccccttaacagggatgactccgcactgcccctcaacagggatgactcagcagagatgactcagcactgtcccttagcagggatgacacagcaaggatgattcagcactgcccctcagcaaggatgactcagcactgccgctcaacagacatgactcagggatggcttagtactgcccctcagcagggatgactcagcaccgcctctcaacagggatgactcagcagggatgactcagcaccgcccctcaacaggcatgactctgcagagatgactcagcactgtcccttagcagggatgacacagcaaggatgactcagcactgcccctcagcaaggatgactcagcactgccgctcaacagggatgactcagggatggcttagtactgcccctcaacagggatgactcagcagggatgactcagcaccacccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggttaacaaaaaatgtgg

SEQ ID NO: 284615 - DNA, 2210 bp, Homo sapiens
gatcttttggaggagaggcagactctgcttagaacaggtggtttgtgttccctggttctcttgagaagggggaccacccataccagtctgtcttaacattttcttcctttctttctttcccctaataacagccagttttgggactgttaccccaaaaaagtttactattaaagctcaatatgaagccagcgaggtgaaattttagggattttagatgtatctgaagctacttctcagcaatatctccccagcctcatccttttcctgttgtctctttatttccagaaggcactggtgttattaaaattgtgtgttggaaggtgtttttctgttttctggaatcttctttctctggaaaatcatatgtaattgctttgtgaagtcttactttgttttctctcagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaaacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagtgctcaccccaggcttccctgacggggatgactcagcactacccctcaacagagatgactttgatgactctgcccctcagcagggcttactaagcactaccccttaacagggatgactccgcactgcccctcaacagggatgactcagcagagatgactcagcactgtcccttagcagggatgacacagcaaggatgattcagcactgcccctcagcaaggatgactcagcactgccgctcaacagacatgactcagggatggcttagtactgcccctcagcagggatgactcagcaccgcctctcaacagggatgactcagcagggatgactcagcaccgcccctcaacaggcatgactctgcagagatgactcagcactgtcccttagcagggatgacacagcaaggatgactcagcactgcccctcagcaaggatgactcagcactgccgctcaacagggatgactcagggatggcttagtactgcccctcaacagggatgactcagcagggatgactcagcaccgcccctcaacaggcatgactctgcagagatgacttagtactgcccctcagcagggatgactcagtactgcccctcagcagggatgactcagcactgcccctcaacagggatgactcagcagggatgactcagcactgtcccttagcagtgatgacacagcaaggatgactcagcactgcccctcagcaaggatgactcagcactgccgctcaacagacatgactcagggatggcttagtactgcccctcagcagggatgactcagcaccgcccctcaacagggatgactcagcactgcccctcaacagggatgactcagcagggatgactcagcactgtcccttagcagcgatgacacagcaaggatgactcagcactgcccctcaccaaggatgactcagcactgccgctcaacagacatgactcagggatggcttagtactgcccctcagcagggatgactcagcagggatgactcagcaccacccttcaacagggatgactcagcaggga

SEQ ID NO: 284616 - DNA, 1261 bp, Homo sapiens
tgttgaggtgggaggatctcagggcgagggcaggtcctccatctttaaggtccacctgcgcccactgaagctggacaagagcctcaataaggacaccctggcgaggaagctggcagtgctcaccccaggcttccctgatgtctgtttacataccaaagttaaaaagctggaatgttaccaagactgctttcttctgcccatagacggggatgactcagcactacccctcaacagagatgactttgatgactctgcccctcagcagggcttactaagcactaccccttaacagggatgactccgcactgcccctcaacagggatgactcagcagagatgactcagcactgtcccttagcagggatgacacagcaaggatgattcagcactgcccctcagcaaggatgactcagcactgccgctcaacagacatgactcagggatggcttagtactgcccctcagcagggatgactcagcaccgcctctcaacagggatgactcagcagggatgactcagcaccgcccctcaacaggcatgactctgcagagatgactcagcactgtcccttagcagggatgacacagcaaggatgactcagcactgcccctcagcaaggatgactcagcactgccgctcaacagggatgactcagggatggcttagtactgcccctcaacagggatgactcagcagggatgactcagcaccacccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggttaacaaaaaatgtgg

SEQ ID NO: 284617 - DNA, 923 bp, Homo sapiens
tcatccccgtcaggaagcctcagcactgtcccttgctgtgtcatccctgctaaggggacagtgctgagtcatccccgtcagggaagcctggggtgagcactgccagcttcctcgccagggtgtccttattagaggctctgcccctcagcagggcttactaagcactaccccttaacagggatgactcagcaccgcccctcaacaggcatgactctgcagagatgactcagcactgcccctcagcagggatggctcagcagggatgactcagcattgcccctcaacagggatgactcagcagactcagcagggatgactcagcactgcccctcaacagacatgactcagcagggacagggatgactcagcaccacccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggttaacaaaaaatgtgg

SEQ ID NO: 284618 - DNA, 398 bp, Homo sapiens
tcatccccgtcaggaagcctcagcactgtcccttgctgtgtcatccctgctaaggggacagtgctgagtcatccccgtcagggaagcctggggtgagcactgccagcttcctcgccagggtgtccttattagaggctctgcccctcagcagggcttactaagcactaccccttaacagggatgactcagcaccgcccctcaacaggcatgactctgcagagatgactcagcactgcccctcagcagggatggctcagcagggatgactcagcattgcccctcaacagggatgactcagcagactcagcagggatgactcagcactgcccctcaacagacatgactcagcagggatccccgagttatctctgctgaatcatccctgctgagtcatcctt

SEQ ID NO: 284619 - DNA, 322 bp, Homo sapiens
tctgaggatgaggcccgtggtttagtgttgaatatgatactcattgctttagctgtgggctggtctgagggtgaggcccctgtttcctgttgaatatcatactcactgctctagctgtgctgattatttttctctttttcccaggtggaccggctggaagtcgtgaacaaacaatctgtgcgtgttattcctgcccctgggacctcttctgaagtgaggggtgaatttaaggctgagtattgcagacataagtttatttcgtgtaaaaatgtagttttctatttttttcagtaaaatactcccttagtatccatcagctact

SEQ ID NO: 284620 - DNA, 340 bp, Homo sapiens
aatgtagcacatataaaatggccactaactatggcgcatattaaaaattagtgaattagttacagagacaaatagcactgtctccttcctcatgaactcaagtacttttagtaggaagtaactaaataaaaatgtacttatttttattcaaatgactccccaattttcattttttactactatcatgtgcttgatatctagaaatctcattaatagaaaatcttaaaagtgtaaatatcacataggtaacagagtgcttttgttcagtgaaggttctgcaatttgtccatctgaattaatttataaacaatcaagtacttattgaatacttttcctttta

SEQ ID NO: 284621 - DNA, 727 bp, Homo sapiens
ttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatgggttagtgattacccagtgtatctttttttttttttgtcttgttctgtcacccaggctggagtgcagccactgcactccagcctgggcgacagagcgagactctgcctcaaaaaaaaaaaattagacaaaacacataaaa

SEQ ID NO: 284622 - DNA, 1722 bp, Homo sapiens
ttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatggggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagca

SEQ ID NO: 284623 - DNA, 824 bp, Homo sapiens
ttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatggggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggtaaggacatcaaaggccaggcatagtggctcacactcgtaatccagccctttgggaggccgaggcag

SEQ ID NO: 284624 - DNA, 785 bp, Homo sapiens
ttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatgggttagtgattacccagtgtatctttttttttttttgtcttgttctgtcacccaggctggagtgcaatggcgcgatctcggcccactgcaacctccgcctctcgggttcaagggattctcttgcctcagcctccgcagtagctgggattacaggcgtctgccaccatgcccgggtgatttttgtatttttagtagagg

SEQ ID NO: 284625 - DNA, 310 bp, Homo sapiens
tagatagatctagagtatcccctcataatgtgtgcccacaccaggcaagtaaaccacctgttttgtttcctcagggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggtaaggacatcaaaggccaggcatagtggctcacactcgtaatccagccctttgggaggccgaggcag

SEQ ID NO: 284626 - DNA, 2100 bp, Homo sapiens
ttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatggggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagcagattacgttagtaagttgttttgtgtcgttggtgtgtcacagtacctgtcacctttggcctggtaacgaggacgtggctaagggaacaccaggaagctgagggctacgctcatggcatccagcagctctgctctgggctcagatggtctgtctttgagattgttcagggcttcactgagccactgtttatgtatccatagaaacggcttaattcaacaggccatgtcagaccttcttggcacctctgcagatacctttttgaggaccttgcagagacggaagtctatgcggaaaactgaatttcaaaatcggcagcctcaccctgcatgtgtcaggaaagtgtcactgtttcctggttccctgtgttagtcctactta

SEQ ID NO: 284627 - DNA, 1301 bp, Homo sapiens
aacttaggctagtacgaggctgcggtgttgaattcggccgaggctttaccgtctagaatacctaaaggagttgccagtcgataagctgaaaggtgtcagcctcattaaggtgaaatttgaggatatcaaggattggtccgacctcgtaacgccacaaggaataatggggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagca

SEQ ID NO: 284628 - DNA, 1664 bp, Homo sapiens
ttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaagggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagca

SEQ ID NO: 284629 - DNA, 1477 bp, Homo sapiens
ttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagca

SEQ ID NO: 284630 - DNA, 1668 bp, Homo sapiens
tgcccgggcgtcgccaggcaaccttcccccttcgcggccgagatggaccctgggctcggcgtcctccggaaaactgcactgtgaggcggggcgatggggaagggccgaagccccgccagcccagctaaagcagacggctcgcactgcgacccgaagcgcgagtcatggctggggccttagtggcaacaagtgctgagatcagcgggctcagtagcaggaacacaagcacccccttgcggtgtctggaggaagcggcgcggacagtctcccgctccaccgtgtcgggcctgaagaggccgctgaacgctcgcgattactgaggcatctggtaggatcgcaaggccatcaacctacaggtgaagctcgaggcgctgtggcgctttgaagccggagagaagctcagtagaatcgggaaggcgctggggctgtccaactccaccttggccaccattcgtgacaacaaggaaaagatctgggcgagttcccaggaggccacactgcaggcggccaccaagttgacgcgtggccgcagcctggtgatggagaacatggagcagctgctgagcatgcggatggaggaccagagccagcgcaacatgcccctcagtgtggtgctcattcgggagaaagcccacagcccgttcgagaaccgcaagcaggagcagggcgagggcgcctagcccgagagcttcggggccggtcgagggtgattcgctggctttaaggcgcgccacagcttgagcagcatcggggccagcggcccaagaacgcagcgtgcaagaacccagcgttaatgcgcagggtgatcccggagggcggctacacactctggctggtgttcaccatgaataagctctggctggtgttcaccatgaataagcccaggttcctctgtaagcgcctgccgagaggacgttcattttcctgtggaagatgagtcggcccctgggtcaaagccgccggagacctcctgaccctattgctcggtggcaacgcagccggcgacttcaagctgaaggccctgctggtgtacccctcggagaacccgtgtttcctcaagggctccttcaagcccaacctgcccttggtgtggtgctcgcacaagaaagcctgggtacagcctgggtgacagagcgagactccgtctcaaaaaaaaaaaaaaaagcctgggtaaccatgagcctcttccaggagtggttcctgcacttctgctctacagtggagggcgctgcacccagtacgaccttccctacaaggggctgcccatcctggacagcactcccggccaccctgggtgttgagacagagtctggctctgtcgcgcaggctggagtgcggtggcgcgatctcggctcactgcaacctccgcctcccgggttcacgccattctcctgcctcagcctcccaggtagctgggactacaggcgcccgccaccacgcccggctaatttttttgtatttttagtagagacggggtttcaccgtgttagccagaatggtctcggtctcctgaccccatgatccacccgccttggcgtcccaaagtgctgggattacaggcgtgagccatggtgcctggccctttaattcccccaatatttttttatctgcattaatttattatttcaagtgaacttccatctcaaatacatggttctcagacgcttc

SEQ ID NO: 284631 - DNA, 1400 bp, Homo sapiens
tgcccgggcgtcgccaggcaaccttcccccttcgcggccgagatggaccctgggctcggcgtcctccggaaaactgcactgtgaggcggggcgatggggaagggccgaagccccgccagcccagctaaagcagacggctcgcactgcgacccgaagcgggcccagcacagggatcacattgtcggggtgacctggatcctacttgaagcctttgagctggactgtggctttatccctgaggccaggcttcatgtccagatggccatgccagaggttgacgtggcagagaaggagtgtgacacaggccagtggagcgagtggagccagcctgtgtgcttccaggctccccagagacaagacggcaccgaaagcgaaggaagctcctgctcctcctaaagccgaagccaaagcgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagcacccccaggagaaacaagcttggccactatgctatcatcaagtttccgctgaccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaagagaagaaggcatatgttcgacttgctcctgattatgatgctttcgatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctatatttctaggagtttggtgaatatttatttataaatgcttatttttttccaagccaagttagaatagagcacttttagaggatttcataaatggaattttgtaatgcctctctggagtttagaaaatatcacctataccttaacataccttatagatacacaaacacaaatagagatttcatagctttcatcctgaaatttcagccatgaatcaggcataaatattctgatggttaatttcagacatctacttgatcggattga

SEQ ID NO: 284632 - DNA, 3319 bp, Homo sapiens
tgcccgggcgtcgccaggcaaccttcccccttcgcggccgagatggaccctgggctcggcgtcctccggaaaactgcactgtgaggcggggcgatggggaagggccgaagccccgccagcccagctaaagcagacggctcgcactgcgacccgaagcgcgagtcatggctggggccttagtggcaacaagtgctgagatcagcgggctcagtagcaggaacacaagcacccccttgcggtgtctggaggaagcggcgcggacagtctcccgctccaccgtgtcgggcctgaagaggccgctgaacgctcgcgattactgaggcatctggtaggatcgcaaggccatcaacctacaggtgaagctcgaggcgctgtggcgctttgaagccggagagaagctcagtagaatcgggaaggcgctggggctgtccaactccaccttggccaccattcgtgacaacaaggaaaagatctgggcgagttcccaggaggccacactgcaggcggccaccaagttgacgcgtggccgcagcctggtgatggagaacatggagcagctgctgagcatgcggatggaggaccagagccagcgcaacatgcccctcagtgtggtgctcattcgggagaaagcccacagcccgttcgagaaccgcaagcaggagcagggcgagggcgcctagcccgagagcttcggggccggtcgagggtgattcgctggctttaaggcgcgccacagcttgagcagcatcggggccagcggcccaagaacgcagcgtgcaagaacccagcgttaatgcgcagggtgatcccggagggcggctacacactctggctggtgttcaccatgaataagctctggctggtgttcaccatgaataagcccaggttcctctgtaagcgcctgccgagaggacgttcattttcctgtggaagatgagtcggcccctgggtcaaagccgccggagacctcctgaccctattgctcggtggcaacgcagccggcgacttcaagctgaaggccctgctggtgtacccctcggagaacccgtgtttcctcaagggctccttcaagcccaacctgcccttggtgtggtgctcgcacaagaaagcctgggtacagcctgggtgacagagcgagactccgtctcaaaaaaaaaaaaaaaagcctgggtaaccatgagcctcttccaggagtggttcctgcacttctgctctacagtggagggcgctgcacccagtacgaccttccctacaaggggctgcccatcctggacagcactcccggccaccctgggtgttgagacagagtctggctctgtcgcgcaggctggagtgcggtggcgcgatctcggctcactgcaacctccgcctcccgggttcacgccattctcctgcctcagcctcccaggtagctgggactacaggcgcccgccaccacgcccggctaatttttttgtatttttagtagagacggggtttcaccgtgttagccagaatggtctcggtctcctgaccccatgatccacccgccttggcgtcccaaagtgctgggattacaggcgtgagccatggtgcctggccctttaattcccccaatatttttttatctgcattaatttattatttcaagtgaacttccatctcaaatacatggttctcagacgcttccatgaactctcaagtgtgacttattacagcctggggctccttggagcacagtgtgccagtgacctagtggaaggccatgagaaagccaggttcactgttcactgtgcagcatctccctccatggtcttcctggagcctattcccactgcactgagcattccgtgtgtccagaggtagggttagcagggatagatggacttcctgcttattttctgttcacatttccactgaccttcaatcctgtagactgcaaagattgagccagctgagcccccaaagagactcagcagtgcagaatgtgggcctgagtgggaggactgcccagccgcccaccttccagctctgttcttcccgggccctggatgcttcttgccacgctgtcctctgaaatgacgctctgccccagcagacctgtggtaggtgagctagtgaggaagcacacctgggctcttcccaccaggcatcccagccctggtgtggggtatccgcatggttgcaggcatcccctggccaggcctgggtgctcattctccctctctcttcttgtctcctcccctctccctgctttctctgccctgtcctcctgctttttgctgttttcccccggactcctgccatgcccccagactttctttttcccacggatatgggctcattccaaggaaagggtggcatttggacacaaggccctagatcccacgatggaggactggggggtacctgatgcccctcagaaagaggcctgcagggacagcacatgggaaagccccatggctttgtgatccatctggggatgtgatccatttgggtaaggacttgggtttcagggcatgagttggcttccttgcaggatgcaggtccttaggtgggtggcctctgtctccagctgtagggccctgccaggaagcctctatatgagcctacctccctcctgcaggaccagagaggggttgttatgaacagcccaggggattggttgcactaagcttgtcttgaagcttttgctggggagtccaggtgcccatgtctctcacctgctccccatacacatctctgcacacctggctgaggcattcccagacctaacctcagataatgtgcatgtgatgaacactcccaagtggctaggcctcttgcacctgagcaggtggattctgccccagcactggggctttctctgggctgtccatcatgggtatatctctggattccaggattgctagttagcacctcacatttgagggtctgtgctattcagtctagaatcagagttggatgagaaatcaactttgaacaccacctttggggtggctgcattggctcacacctgtaatctcagcactttgggaggctgaggcaggaggatagcttgaggccaggagttcgagactaaccggagcaacatagtaaggccacatctgtacaaaaaaaagaaagaaaaaattacccaggtttggtggcatgcacttgtagtcccagttgtgggctgaggattatgcaggtgacaaggcaagagactgaaggcacaaactgtttcagtataataaagaaaatagaataataatagtcataattatatatagagatgatcatgaacaattatcaatcattataataaacattattaatcattagcttttaaaaatactct

SEQ ID NO: 284633 - DNA, 2871 bp, Homo sapiens
tgcccgggcgtcgccaggcaaccttcccccttcgcggccgagatggaccctgggctcggcgtcctccggaaaactgcactgtgaggcggggcgatggggaagggccgaagccccgccagcccagctaaagcagacggctcgcactgcgacccgaagcgcgagtcatggctggggccttagtggcaacaagtgctgagatcagcgggctcagtagcaggaacacaagcacccccttgcggtgtctggaggaagcggcgcggacagtctcccgctccaccgtgtcgggcctgaagaggccgctgaacgctcgcgattactgaggcatctggtaggatcgcaaggccatcaacctacaggtgaagctcgaggcgctgtggcgctttgaagccggagagaagctcagtagaatcgggaaggcgctggggctgtccaactccaccttggccaccattcgtgacaacaaggaaaagatctgggcgagttcccaggaggccacactgcaggcggccaccaagttgacgcgtggccgcagcctggtgatggagaacatggagcagctgctgagcatgcggatggaggaccagagccagcgcaacatgcccctcagtgtggtgctcattcgggagaaagcccacagcccgttcgagaaccgcaagcaggagcagggcgagggcgcctagcccgagagcttcggggccggtcgagggtgattcgctggctttaaggcgcgccacagcttgagcagcatcggggccagcggcccaagaacgcagcgtgcaagaacccagcgttaatgcgcagggtgatcccggagggcggctacacactctggctggtgttcaccatgaataagctctggctggtgttcaccatgaataagcccaggttcctctgtaagcgcctgccgagaggacgttcattttcctgtggaagatgagtcggcccctgggtcaaagccgccggagacctcctgaccctattgctcggtggcaacgcagccggcgacttcaagctgaaggccctgctggtgtacccctcggagaacccgtgtttcctcaagggctccttcaagcccaacctgcccttggtgtggtgctcgcacaagttacaggcgtgagccatggtgcctggccctttaattcccccaatatttttttatctgcattaatttattatttcaagtgaacttccatctcaaatacatggttctcagacgcttccatgaactctcaagtgtgacttattacagcctggggctccttggagcacagtgtgccagtgacctagtggaaggccatgagaaagccaggttcactgttcactgtgcagcatctccctccatggtcttcctggagcctattcccactgcactgagcattccgtgtgtccagaggtagggttagcagggatagatggacttcctgcttattttctgttcacatttccactgaccttcaatcctgtagactgcaaagattgagccagctgagcccccaaagagactcagcagtgcagaatgtgggcctgagtgggaggactgcccagccgcccaccttccagctctgttcttcccgggccctggatgcttcttgccacgctgtcctctgaaatgacgctctgccccagcagacctgtggtaggtgagctagtgaggaagcacacctgggctcttcccaccaggcatcccagccctggtgtggggtatccgcatggttgcaggcatcccctggccaggcctgggtgctcattctccctctctcttcttgtctcctcccctctccctgctttctctgccctgtcctcctgctttttgctgttttcccccggactcctgccatgcccccagactttctttttcccacggatatgggctcattccaaggaaagggtggcatttggacacaaggccctagatcccacgatggaggactggggggtacctgatgcccctcagaaagaggcctgcagggacagcacatgggaaagccccatggctttgtgatccatctggggatgtgatccatttgggtaaggacttgggtttcagggcatgagttggcttccttgcaggatgcaggtccttaggtgggtggcctctgtctccagctgtagggccctgccaggaagcctctatatgagcctacctccctcctgcaggaccagagaggggttgttatgaacagcccaggggattggttgcactaagcttgtcttgaagcttttgctggggagtccaggtgcccatgtctctcacctgctccccatacacatctctgcacacctggctgaggcattcccagacctaacctcagataatgtgcatgtgatgaacactcccaagtggctaggcctcttgcacctgagcaggtggattctgccccagcactggggctttctctgggctgtccatcatgggtatatctctggattccaggattgctagttagcacctcacatttgagggtctgtgctattcagtctagaatcagagttggatgagaaatcaactttgaacaccacctttggggtggctgcattggctcacacctgtaatctcagcactttgggaggctgaggcaggaggatagcttgaggccaggagttcgagactaaccggagcaacatagtaaggccacatctgtacaaaaaaaagaaagaaaaaattacccaggtttggtggcatgcacttgtagtcccagttgtgggctgaggattatgcaggtgacaaggcaagagactgaaggcacaaactgtttcagtataataaagaaaatagaataataatagtcataattatatatagagatgatcatgaacaattatcaatcattataataaacattattaatcattagcttttaaaaatactct

SEQ ID NO: 284634 - DNA, 1332 bp, Homo sapiens
tgcccgggcgtcgccaggcaaccttcccccttcgcggccgagatggaccctgggctcggcgtcctccggaaaactgcactgtgaggcggggcgatggggaagggccgaagccccgccagcccagctaaagcagacggctcgcactgcgacccgaagcgcgagtcatggctggggccttagtggcaacaagtgctgagatcagcgggctcagtagcaggaacacaagcacccccttgcggtgtctggaggaagcggcgcggacagtctcccgctccaccgtgtcgggcctgaagaggccgctgaacgctcgcgattactgaggcatctggtaggatcgcaaggccatcaacctacaggtgaagctcgaggcgctgtggcgctttgaagccggagagaagctcagtagaatcgggaaggcgctggggctgtccaactccaccttggccaccattcgtgacaacaaggaaaagatctgggcgagttcccaggaggccacactgcaggcggccaccaagttgacgcgtggccgcagcctggtgatggagaacatggagcagctgctgagcatgcggatggaggaccagagccagcgcaacatgcccctcagtgtggtgctcattcgggagaaagcccacagcccgttcgagaaccgcaagcaggagcagggcgagggcgcctagcccgagagcttcggggccggtcgagggtgattcgctggctttaaggcgcgccacagcttgagcagcatcggggccagcggcccaagaacgcagcgtgcaagaacccagcgttaatgcgcagggtgatcccggagggcggctacacactctggctggtgttcaccatgaataagctctggctggtgttcaccatgaataagcccaggttcctctgtaagcgcctgccgagaggacgttcattttcctgtggaagatgagtcggcccctgggtcaaagccgccggagacctcctgaccctattgctcggtggcaacgcagccggcgacttcaagctgaaggccctgctggtgtacccctcggagaacccgtgtttcctcaagggctccttcaagcccaacctgcccttggtgtggtgctcgcacaagaaagcctgggtacagcctgggtgacagagcgagactccgtctcaaaaaaaaaaaaaaaagcctgggtaaccatgagcctcttccaggagtggttcctgcacttctgctctacagtggagggcgctgcacccagtacgaccttccctacaaggggctgcccatcctggacagcactcccggccaccctgggtgttgagacagagcgagactccgtctcaaaaaaaaaa

SEQ ID NO: 284635 - DNA, 3019 bp, Homo sapiens
tgcccgggcgtcgccaggcaaccttcccccttcgcggccgagatggaccctgggctcggcgtcctccggaaaactgcactgtgaggcggggcgatggggaagggccgaagccccgccagcccagctaaagcagacggctcgcactgcgacccgaagcgcgagtcatggctggggccttagtggcaacaagtgctgagatcagcgggctcagtagcaggaacacaagcacccccttgcggtgtctggaggaagcggcgcggacagtctcccgctccaccgtgtcgggcctgaagaggccgctgaacgctcgcgattactgaggcatctggtaggatcgcaaggccatcaacctacaggtgaagctcgaggcgctgtggcgctttgaagccggagagaagctcagtagaatcgggaaggcgctggggctgtccaactccaccttggccaccattcgtgacaacaaggaaaagatctgggcgagttcccaggaggccacactgcaggcggccaccaagttgacgcgtggccgcagctggtgttcaccatgaataagctctggctggtgttcaccatgaataagcccaggttcctctgtaagcgcctgccgagaggacgttcattttcctgtggaagatgagtcggcccctgggtcaaagccgccggagacctcctgaccctattgctcggtggcaacgcagccggcgacttcaagctgaaggccctgctggtgtacccctcggagaacccgtgtttcctcaagggctccttcaagcccaacctgcccttggtgtggtgctcgcacaagaaagcctgggtacagcctgggtgacagagcgagactccgtctcaaaaaaaaaaaaaaaagcctgggtaaccatgagcctcttccaggagtggttcctgcacttctgctctacagtggagggcgctgcacccagtacgaccttccctacaaggggctgcccatcctggacagcactcccggccaccctgggtgttgagacagagtctggctctgtcgcgcaggctggagtgcggtggcgcgatctcggctcactgcaacctccgcctcccgggttcacgccattctcctgcctcagcctcccaggtagctgggactacaggcgcccgccaccacgcccggctaatttttttgtatttttagtagagacggggtttcaccgtgttagccagaatggtctcggtctcctgaccccatgatccacccgccttggcgtcccaaagtgctgggattacaggcgtgagccatggtgcctggccctttaattcccccaatatttttttatctgcattaatttattatttcaagtgaacttccatctcaaatacatggttctcagacgcttccatgaactctcaagtgtgacttattacagcctggggctccttggagcacagtgtgccagtgacctagtggaaggccatgagaaagccaggttcactgttcactgtgcagcatctccctccatggtcttcctggagcctattcccactgcactgagcattccgtgtgtccagaggtagggttagcagggatagatggacttcctgcttattttctgttcacatttccactgaccttcaatcctgtagactgcaaagattgagccagctgagcccccaaagagactcagcagtgcagaatgtgggcctgagtgggaggactgcccagccgcccaccttccagctctgttcttcccgggccctggatgcttcttgccacgctgtcctctgaaatgacgctctgccccagcagacctgtggtaggtgagctagtgaggaagcacacctgggctcttcccaccaggcatcccagccctggtgtggggtatccgcatggttgcaggcatcccctggccaggcctgggtgctcattctccctctctcttcttgtctcctcccctctccctgctttctctgccctgtcctcctgctttttgctgttttcccccggactcctgccatgcccccagactttctttttcccacggatatgggctcattccaaggaaagggtggcatttggacacaaggccctagatcccacgatggaggactggggggtacctgatgcccctcagaaagaggcctgcagggacagcacatgggaaagccccatggctttgtgatccatctggggatgtgatccatttgggtaaggacttgggtttcagggcatgagttggcttccttgcaggatgcaggtccttaggtgggtggcctctgtctccagctgtagggccctgccaggaagcctctatatgagcctacctccctcctgcaggaccagagaggggttgttatgaacagcccaggggattggttgcactaagcttgtcttgaagcttttgctggggagtccaggtgcccatgtctctcacctgctccccatacacatctctgcacacctggctgaggcattcccagacctaacctcagataatgtgcatgtgatgaacactcccaagtggctaggcctcttgcacctgagcaggtggattctgccccagcactggggctttctctgggctgtccatcatgggtatatctctggattccaggattgctagttagcacctcacatttgagggtctgtgctattcagtctagaatcagagttggatgagaaatcaactttgaacaccacctttggggtggctgcattggctcacacctgtaatctcagcactttgggaggctgaggcaggaggatagcttgaggccaggagttcgagactaaccggagcaacatagtaaggccacatctgtacaaaaaaaagaaagaaaaaattacccaggtttggtggcatgcacttgtagtcccagttgtgggctgaggattatgcaggtgacaaggcaagagactgaaggcacaaactgtttcagtataataaagaaaatagaataataatagtcataattatatatagagatgatcatgaacaattatcaatcattataataaacattattaatcattagcttttaaaaatactct

SEQ ID NO: 284636 - DNA, 1810 bp, Homo sapiens
aacctgttctccgggctaggggacaaacagggaaaaagaaaatattacaggcgtgagccatggtgcctggccctttaattcccccaatatttttttatctgcattaatttattatttcaagtgaacttccatctcaaatacatggttctcagacgcttccatgaactctcaagtgtgacttattacagcctggggctccttggagcacagtgtgccagtgacctagtggaaggccatgagaaagccaggttcactgttcactgtgcagcatctccctccatggtcttcctggagcctattcccactgcactgagcattccgtgtgtccagaggtagggttagcagggatagatggacttcctgcttattttctgttcacatttccactgaccttcaatcctgtagactgcaaagattgagccagctgagcccccaaagagactcagcagtgcagaatgtgggcctgagtgggaggactgcccagccgcccaccttccagctctgttcttcccgggccctggatgcttcttgccacgctgtcctctgaaatgacgctctgccccagcagacctgtggtaggtgagctagtgaggaagcacacctgggctcttcccaccaggcatcccagccctggtgtggggtatccgcatggttgcaggcatcccctggccaggcctgggtgctcattctccctctctcttcttgtctcctcccctctccctgctttctctgccctgtcctcctgctttttgctgttttcccccggactcctgccatgcccccagactttctttttcccacggatatgggctcattccaaggaaagggtggcatttggacacaaggccctagatcccacgatggaggactggggggtacctgatgcccctcagaaagaggcctgcagggacagcacatgggaaagccccatggctttgtgatccatctggggatgtgatccatttgggtaaggacttgggtttcagggcatgagttggcttccttgcaggatgcaggtccttaggtgggtggcctctgtctccagctgtagggccctgccaggaagcctctatatgagcctacctccctcctgcaggaccagagaggggttgttatgaacagcccaggggattggttgcactaagcttgtcttgaagcttttgctggggagtccaggtgcccatgtctctcacctgctccccatacacatctctgcacacctggctgaggcattcccagacctaacctcagataatgtgcatgtgatgaacactcccaagtggctaggcctcttgcacctgagcaggtggattctgccccagcactggggctttctctgggctgtccatcatgggtatatctctggattccaggattgctagttagcacctcacatttgagggtctgtgctattcagtctagaatcagagttggatgagaaatcaactttgaacaccacctttggggtggctgcattggctcacacctgtaatctcagcactttgggaggctgaggcaggaggatagcttgaggccaggagttcgagactaaccggagcaacatagtaaggccacatctgtacaaaaaaaagaaagaaaaaattacccaggtttggtggcatgcacttgtagtcccagttgtgggctgaggattatgcaggtgacaaggcaagagactgaaggcacaaactgtttcagtataataaagaaaatagaataataatagtcataattatatatagagatgatcatgaacaattatcaatcattataataaacattattaatcattagcttttaaaaatactct

SEQ ID NO: 284637 - DNA, 1108 bp, Homo sapiens
ggcgcctgcgcggcggggttctcggtcgccagccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagctcggccctttctcctatgggggtcaggcagctgcagcttcttcgctca

SEQ ID NO: 284638 - DNA, 1124 bp, Homo sapiens
ggacgcgtgggtcggacgcgtgggtcccgggaccgcgttgggtcgacccacgcgtccgggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagctcggccctttctcctatgggggtcaggcagctgcagcttcttcgctca

SEQ ID NO: 284639 - DNA, 1056 bp, Homo sapiens
tgcgcggttgggaggggtggggaagtgcgcgggagcaggtcggaggtgttgggggcgcgttgggtagagccaccctcctcccctgcggtccaggaaccgtccaccaagtaggaggaagcggctctgggtgggtgcggcggccactgcgagccaagctacggggccggggacgcgcctgagagccttgcgagtgttccggggggcgcgccttctcctggtctcctgggcctggcacccagcggaaattgggaagtgacgggcacaagccggatcatgaagcggggaagatttctccacttccccacttcctctccagacgtcggtcagagcaagggaagagggaaaaggtgggggctgacgccccaaggccgccctcctgttccctcccgatgaatgtgctcaagcggaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagctcggccctttctcctatgggggtcaggcagctgcagcttcttcgctca

SEQ ID NO: 284640 - DNA, 828 bp, Homo sapiens
ggacgcgtgggtcggacgcgtgggtcccgggaccgcgttgggtcgacccacgcgtccgggaggactgccggtcgttcggacgtcttgcctgtcgctggaggagaggtccgggctctccaggaaggtgctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaag

SEQ ID NO: 284641 - DNA, 618 bp, Homo sapiens
tgttacatggagcagcagcacagtcaagcagggaacagatcacgtaaagccctttagagagtgaagtcggctttttatgctaggtgcaactgggagttctgaacacggcaaagttggacattccaaagatggcgtagatgaacatgaccaggaagagcaggaggccgatgttaaacaacgcaggaagggacatcatcaaagcaaagagcagcgtgcggatcccctttgctcctttgactagacgtaggattcggccaatcctggcaagacggatcactcggaacagggtaacagagatctctggaggtgaaacattgctctgaactggcattgattctagcccagctcttgtagaccaattaccaacttgtccatctccctccagtgcctggaactggacctggcacacaggcctctggctcatcggaattcataggttcagcctctgcttcttctccttctccaggcaaagggttatcaactgtgctgcactctgaggagcttgaccggtttaatctctagaaaggaattcaccaccccaccaggaccagagatctctgaggtgaacattgtctgaacggattgttctagccagtctgtaaccattacatgtcattc

SEQ ID NO: 284642 - DNA, 989 bp, Homo sapiens
  misc_feature (760)..(760): n is a, c, g, or t
  misc_feature (782)..(782): n is a, c, g, or t
  misc_feature (881)..(881): n is a, c, g, or t
  misc_feature (942)..(942): n is a, c, g, or t
tgttacatggagcagcagcacagtcaagcagggaacagatcacgtaaagccctttagagagtgaagtcggctttttatgctaggtgcaactgggagttctgaacacggcaaagttggacattccaaagatggcgtagatgaacatgaccaggaagagcaggaggccgatgttaaacaacgcaggaagggacatcatcaaagcaaagagcagcgtgcggatcccctttgctcctttgactagacgtaggattcggccaatcctggcaagacggatcactcggaacagggtaacagagatctctggaggtgaaacattgctctgaactggcattgattctagcccagctcttgtagaccaattaccaacttgtccatctccctccagtgcctggaactggacctggcacacaggcaaagggttatcaactgtgctgcactctgaggagcttgaccggtttaatctctagaaaggaattcaccaccccaccaggcacgcggaacacaatcaggaaggagtggaagaagtcgttcatgtgccaccgtgggagcgtacagtcatcattgatcttgcagacacattctttgtagctcttaccaaagagctgcatgccgaccacagcaaaaatgaagacgatgatggccaacactaagaagctgtccattggggagcatgagggctgagcgtccatcaaccagggagaccacaccgttgcagtccacagcactgtgcattttcccgttcaccggcagcattggtggngacctactggcttggctgatgntactgctgcgtcgctcctggggtctgtggagcacaaacagtgagccccttctgctctcattgtctacaagatgctgtgctcatcatcggcaaattcagnctcagatcctatatctcttcctcttgcctttgaactaaaaagacttgttctgctgcttcgncctgcagaaacaaggagcacgatgctcgagtgggactgcaaaaaaat

SEQ ID NO: 284643 - DNA, 623 bp, Homo sapiens
tgcactcacagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcaggtaaagaattaaagcctagaatgtttgaatcct

SEQ ID NO: 284644 - DNA, 1786 bp, Homo sapiens
tgcactcacagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcaggtcagttcaagtagacaatctctgcctatcaaggctatacttaagtcgcttccagtctgggctatttccattggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaagtgtgaaacagagcacttgcagagcctgggacaacctccttattgaagggaagagggaccagcacatgaggctgaggctgaggggcagtcaccagcaccaggaagaaggtggtaggaggagtcctaggggccggttttaccctcccacatatcctgtgtgcatcgttttttaacatgtgttgtttgtaacatgtaatatatctgaattttaaatgggggtggtgatttatctcagtcttcctctctgcatcagttgctttataaatgattgtcaaaccaataaatacacacaagataaaattttattctaaggcttcatg

SEQ ID NO: 284645 - DNA, 442 bp, Homo sapiens
agtaacttaaggttgtcattggtaaaaagacttctgtgtcagaaaaaacaaaaggctcttttcagagccacctaccgtctcagaaaaaggctgtacgttacaaaacgttactgctgttaaccagccatcttacttgcctgtcacaaatgcccgtttaagcgcatttcgggaatgtacggggactgaattttcaaggagcgttccatcggccattagtttgagccttcctctgtcgcacagacgagtgcagtggcctgatctcagctcactgcagcctctgcctcctggattcaagcgattctcctccctcattctcccaagtagctgggattacaggagatgaaagatgccctccctataccagaaggaaagtatcattctcatcaaggacagaaaattaaggccaaggaaaatctgtacaaataaaccttgttacaccaac

SEQ ID NO: 284646 - DNA, 2065 bp, Homo sapiens
tgcactcacagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcaggtcagttcaagtagacaatctctgcctatcaaggctatacttaagtcgcttccagtctgggctatttccattggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaaggtgagaagtgatcagattaaggacaatttttgaaactgggaatgcaggagacagaggagataaggatgactcctcagacgagaaggaataacgggtgcaggtttggagaagaggagaccatgttaagcctgagaatattagacatcctgaaatggctgtgggactctgtggggatgctaaggctggagatataaatttgggaggctgggcctctttaacatcaaaagatgaggatgaaaaagagaagtttgcaaaaaagactgggaagggccttcaacgaagtaggaagaacagttgtaaaatggagactcgaagtgaaaaaggttgggagcaaggacctttggcaagtgctataatatcaagacattacattatataaggtctaagaatttacaatggtttaggcaagagaaactttaaaggtaaccctgactaaaatgattttcaaatgaatgatggagacaaagagtcctttaaggtgtgttcaaggtataatactgtgctttgcttatgtaaactctatcagtggtaaatgaattggaggagaaatgtctctttgtagaataattttggctaatacataaataagaattgaaag

SEQ ID NO: 284647 - DNA, 1818 bp, Homo sapiens
tgcactcacagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcaggtcagttcaagtagacaatctctgcctatcaaggctatacttaagtcgcttccagtctgggctatttccattggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaagccttcctctgtcgcacagacgagtgcagtggcctgatctcagctcactgcagcctctgcctcctggattcaagcgattctcctccctcattctcccaagtagctgggattacaggcatgtaccatcatgtctggctaatgtttatatctttagcacagacggggtttcaccatgttggccaggctggtctcgaactcctgaccacccaccttggccttatcctaaagtgctgggattacagacgtgagcaaccatgcccggctgacttattttttattataatcagactaatatgacactgtcttatgcctaatgctgggtttttatgggatttgtgtaattccaaaattg

SEQ ID NO: 284648 - DNA, 337 bp, Homo sapiens
tggatctgtggtaacctagcaggtcagttatcagacttcttcctgaccaggaatattctcagcgtaattgctgtccggaaactcttcacagcagcaggtaagcaacagccagaacatttaagcacttgggagatacttctcccctatctttaggatgcacctgactatgttgtctgaatcactccccaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccag

SEQ ID NO: 284649 - DNA, 607 bp, Homo sapiens
aaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggtattaaaataatgctaaaactgaacagagtttaaattcacaggaagtattagagattaaatgtcaaacctttctcatttcaggggatagttgcaacagcccagtttgaaatatatgtcaaatgggctcctcccctggaacgaggccgacttacttctatgagtacatcaggtaaagaattaaagcctagaatgtttgaatcctatcttcatctcattgtattacattcttccctagagccataagaaatgtgtgttttgaatggtcaagggctttggaaatcatctgtttcagcattcttgctatgaagatgagagaattgtatagaatggagaagagccatccttatctcaaacaacagagaaaaagagag

SEQ ID NO: 284650 - DNA, 3279 bp, Homo sapiens
  misc_feature (1013)..(1013): n is a, c, g, or t
cactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccntgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaataga

SEQ ID NO: 284651 - DNA, 3184 bp, Homo sapiens
  misc_feature (1013)..(1013): n is a, c, g, or t
cactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccntgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaataga

SEQ ID NO: 284652 - DNA, 3452 bp, Homo sapiens
  misc_feature (1013)..(1013): n is a, c, g, or t
  misc_feature (3289)..(3290): n is a, c, g, or t
  misc_feature (3303)..(3304): n is a, c, g, or t
  misc_feature (3328)..(3328): n is a, c, g, or t
cactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccntgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagaaaaaacaaanntactaaaagggannttaaacctggccattttataaagnaaggaccctttgatattcctgcccaaggttgccctaagtttggcaaatccgcccaattatctcaaaaaaaaaaaccccgggggggggcctctgccccaattggcccttttgggaggcttaaaaa

SEQ ID NO: 284653 - DNA, 3152 bp, Homo sapiens
  misc_feature (886)..(886): n is a, c, g, or t
gagagtctctgctgctcctgctgctgctcctgctgctcctgttctgctcctgctgctcgtgctgctcctgctgctcctgcccggctcccctctagttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccntgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaataga

SEQ ID NO: 284654 - DNA, 3629 bp, Homo sapiens
  misc_feature (1013)..(1013): n is a, c, g, or t
cactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccntgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagaaaaaaaaaaaaaaaaaaaagaaaaaaaaacacagaaaaaaaaaaagaaaaaaagaagaaaaaaaaaagaaagagaaaaggaacagaaaagagaagaagaaagagcaggacagagggaggagccaaaacaggcaagacaaaaaaaggcgagcagggacaaaaatatagcacacgcggaggcgagaacaaacacagagaagcagaggaataagaaagaggagaggagcgacgaaaagagacaaaacaaaaggaagaacaagaggggagaaaaaaaagaagagcaggaggaacaaacagaggtgggtaaaagaggaaagacaaaaagaggggggagaaaacagaagaacacat

SEQ ID NO: 284655 - DNA, 1869 bp, Homo sapiens
aggggcactctgcgataagatttcttttatttattcactgtagcaatagtgtcctgaattaactttctctccactattagcacatattccttttatacatagccctttataaaaatgaaaaaaaaaatcccttttaagctgctaagttcctttttcctcccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaataga

SEQ ID NO: 284656 - DNA, 1915 bp, Homo sapiens
ggatgaacacgtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagacacgtttgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaataga

SEQ ID NO: 284657 - DNA, 1794 bp, Homo sapiens
  misc_feature (1013)..(1013): n is a, c, g, or t
cactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccntgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggagcagtgccccatgtgctcaccaagcagcatggctggatccttggagggcaatgggtggccagtgcccttctcatcaccctcatcgcactccgcagcctccacctccctccttgtgcagccttagctctgtgcccccacagagctccccacaaggccatacacgtggtcggtgtgaacagcacagaaggaagggggcggacttgagcaccttcccacatttggaagaaaaaacttaatccacagcatctgaaattaccagagctaatctttttaaaaagtacggaaataaatgactgcccagctttgatttctaaaataataatttggaacatattggcagttaataaatgatgatatgaaaacctggacatttatctttggggtgagtagtgactga

SEQ ID NO: 284658 - DNA, 1555 bp, Homo sapiens
cactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggagcagtgccccatgtgctcaccaagcagcatggctggatccttggagggcaatgggtggccagtgcccttctcatcaccctcatcgcactccgcagcctccacctccctccttgtgcagccttagctctgtgcccccacagagctccccacaaggccatacacgtggtcggtgtgaacagcacagaaggaagggggcggacttgagcaccttcccacatttggaagaaaaaacttaatccacagcatctgaaattaccagagctaatctttttaaaaagtacggaaataaatgactgcccagctttgatttctaaaataataatttggaacatattggcagttaataaatgatgatatgaaaacctggacatttatctttggggtgagtagtgactga

SEQ ID NO: 284659 - DNA, 849 bp, Homo sapiens
cggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcggtgagtaaggtggcctcagtggcaggccggtaccggcgggctggggacctggtgatttctgcctccgcgggtgactttggcgggctttggggaccgagcgagctgtccgccggcgggctccggggagcatcgtgccaggagccgggcgggcaccccagctcctctgcctgcgtcccggccgctttccgctccgcaccacccgactgggggccccgcggggcactgcgggaacggctggtacgcgcccgggcgcatgttggctcggagaggccggcggctccagcctcctgcgccaggagacaccggagagctgggacctttgcccctaacggggctctaccaggtccaggctgcatttgcatccgggggtgccttctctgggagctgattccggccaataaaacgcaagttgcctgaacttcaaaacacaagggaacttgtttctttgaaaagtagcggtcaaaagttcgggagctctgcgatctaaataatcccgaggcacggaggagggggtgcgtggtctgtcgtggactcagagctgcgaaatgatttcttcagaattcagtcaacctctaccgaggaaaccagaggcatcctgtaccaccccctccccgccagtaattatgtatgtga

SEQ ID NO: 284660 - DNA, 1942 bp, Homo sapiens
ggcagtcggtgggcgcggcggctgctggaggctagcgcgacccgactcttaagttttcttttcctctccagaggggccgattagggagagagaccaggaatgagtggaatgctatcttaagccaaaaaaaactattataatttttatttagtactacttaaatgaagagagataaaaaaagaaacaaaattccaattgataattatcccattcagacattagtgaatatgtcactcaatccaagtcgaccttcctcatcagagttggtggaacttcatgttttttatgtccctgaaggatcatggaactataagctaaataccatttcaacagaagttgttaacaaattcatttcagctggatttctaagagtatctcctcaacttactttacgagccctgagggagcgtcttggtgagttcctgggtgaagatgctattgcagaaaaatttttatttctgaaatgcattggaaataatttagctgtggtgaaggaaaagcaagaatcagaactgaaactcaaatcatttgctcctccatatgctcctcaaccagaattatatttgcttcctgtaatggaccatttaggaaatgtttattcaccatcaacagttattttagatgagcggcagactaataatggtgttaatgaggctgatggaacaatccacagaccaattagtgtaactttgttcaaggaggaacttggaagagatcccagtttgttagaaaacactttgaaagagcttcctaacaagaatcaggaagaagctgggggaaaagccactgcagaaaaaagccaaattgcaaaaaatcaaattggaaattctgagttgccaggatcattggaagattcaaataatgattgctttggcactaaaaaaagtgtctttgggaaaatgaagatgatacagctatcagtagaagacaggacaatcagacagctgaaaaagagtacatcaccctaccagatcacccttcacttccttgtcaacctgttctttcttcaggaataactgatatatctttattacaaactgaaagagagaagattatcaaacaaatgaaacaagtaaaggaagaaagaaggtatctggaaagaaatagagaagaaccagtaaaaacggttgaaaagctatttgaacaaagcaaattaaaacgatatcatgcctacaatggttggaagaaaaaatacttggaaacaaagaaagtcacagcatcaatggaggaggttttaacaaaacttcgagaagatttggaactctactataaaaaactgctcatgcaacttgaagccagggagatcaagatgagaccaaagaatctggcaaacatcacagactccaagaattacctaataatccagatcactgaggtacagcatgcaattgaccagcttaagagaaaactagatactgacaaaatgaaactcatagtagaagttaagatgagaaaacaagcagtttcagatttacgaacattgaaaactgaactggcacagaaaaaaaaaataatacatctctacaatctcaattagttgctagaagtgtgcctggctaggaggtctacagaagattttgtttatgatgaatcagccaagtcaaaagggagcattggctgctgcaatacattctgaccagatctgactttgttcatcataagacatcacaaagaggaagtcacaagcatctgcaattccagtataattatagcatcttctgtctatgttctttggagaccaagctacatcaaaggttacctgtggaaaaaaatcttactattttatgtaatatgatcacgtgtgcatattacgtcagatttttaaaattatatatattttttaccttatactacacaaggaaaaggaactgcttacagtatatgaatgtagggtttgacacacatagaacttgaaccattctaagaaatattttttgcttac

SEQ ID NO: 284661 - DNA, 1717 bp, Homo sapiens
ggcagtcggtgggcgcggcggctgctggaggctagcgcgacccgactcttaagttttcttttcctctccagaggggccgattagggagagagaccaggaatgagtggaatgctatcttaagccaaaaaaaactattataatttttatttagtactacttaaatgaagagagataaaaaaagaaacaaaattccaattgataattatcccattcagacattagtgaatatgtcactcaatccaagtcgaccttcctcatcagagttggtggaacttcatgttttttatgtccctgaaggatcatggaactataagctaaataccatttcaacagaagttgttaacaaattcatttcagctggatttctaagagtatctcctcaacttactttacgagccctgagggagcgtcttggtgagttcctgggtgaagatgctattgcagaaaaatttttatttctgaaatgcattggaaataatttagctgtggtgaaggaaaagcaagaatcagaactgaaactcaaatcatttgctcctccatatgctcctcaaccagaattatatttgcttcctgtaatggaccatttaggaaatgtttattcaccatcaacagttattttagatgagcggcagactaataatggtgttaatgaggctgatggaacaatccacagaccaattagtgtaactttgttcaaggaggaacttggaagagatcccagtttgttagaaaacactttgaaagagcttcctaacaagaatcaggaagaagctgggggaaaagccactgcagaaaaaagccaaattgcaaaaaatcaaattggaaattctgagttgccaggatcattggaagattcaaataatgattgctttggcactaaaaaaagtgtctttgggaaaatgaagatgatacagctatcagtagaagacaggacaatcagacagctgaaaaagagtacatcaccctaccagatcacccttcacttccttgtcaacctgttctttcttcaggaataactgatatatctttattacaaactgaaacctacaatggttggaagaaaaaatacttggaaacaaagaaagtcacagcatcaatggaggaggttttaacaaaacttcgagaagatttggaactctactataaaaaactgctcatgcaacttgaagccagggagatcaagatgagaccaaagaatctggcaaacatcacagactccaagatgagaaaacaagcagtttcagatttacgaacattgaaaactgaactggcacagaaaaaaaaaataatacatctctacaatctcaattagttgctagaagtgtgcctggctaggaggtctacagaagattttgtttatgatgaatcagccaagtcaaaagggagcattggctgctgcaatacattctgaccagatctgactttgttcatcataagacatcacaaagaggaagtcacaagcatctgcaattccagtataattatagcatcttctgtctatgttctttggagaccaagctacatcaaaggttacctgtggaaaaaaatcttactattttatgtaatatgatcacgtgtgcatattacgtcagatttttaaaattatatatattttttaccttatactacacaaggaaaaggaactgcttacagtatatgaatgtagggtttgacacacatagaacttgaaccattctaagaaatattttttgcttac

SEQ ID NO: 284662 - DNA, 860 bp, Homo sapiens
ggcagtcggtgggcgcggcggctgctggaggctagcgcgacccgactcttaagttttcttttcctctccagaggggccgattagggagagagaccaggaatgagtggaatgctatcttaagccaaaaaaaactattataatttttatttagtactacttaaatgaagagagataaaaaaagaaacaaaattccaattgataattatcccattcagacattagtgaatatgtcactcaatccaagtcgaccttcctcatcagagttggtggaacttcatgttttttatgtccctgaaggatcatggaactataagctaaataccatttcaacagaagttgttaacaaattcatttcagctggatttctaagagtatctcctcaacttactttacgagccctgagggagcgtcttggtgagttcctgggtgaagatgctattgcagaaaaatttttatttctgaaatgcattggaaataatttagctgtggtgaaggaaaagcaagaatcagaactgaaactcaaatcatttgctcctccatatgctcctcaaccagaattatatttgcttcctgtaatggaccatttaggaaatgtttattcaccatcaacagttattttagatgagcggcagactaataatggtgttaatgaggctgatggaacaatccacagaccaattagtgtaactttgttcaaggaggaacttggaagagatcccagtttgttagaaaacactttgaaagagcttcctaacaagaatcaggaagaagaaatgaagacacatacagactcttaaagcctcttatattaaaatataaacatttcatattaataaatatagatctgtgtcattatagaa

SEQ ID NO: 284663 - DNA, 565 bp, Homo sapiens
aaatactagtatctgattctgtaaaatttttgaaaaaaaaataagagactaatacacttagaagagtgcttgccacagagtaaacactatatttctgaaatatctattccgttcctaagggctaggaattaagggttttttttgtattttgttttcttgttgttttcactattttctttacacattgagaacaacaggttttgaagtttaagcaaaacataaaattctttctcactctagtttttagaacagttcaattgtattgtccctatctactcataaacaaggttaccttatagcatatctcaccagtagataagcatgcttattaaacagcattcataatctacacatttactgtagtaatccagtgggagttgaaagcactgaagccaaatgagagaagacagttaaagcggttacaaaaaccctgtttacatgacaactatgatgtacttttagaagggtatgatgaagttcatttttgaaaagtaattctttttatagatgagaaaacaagcagtttcagatttacgaacattgaaaactgaactggcacagaaaa

SEQ ID NO: 284664 - DNA, 691 bp, Homo sapiens
tggaaataatacacaaatgaagcctgatttatttaaagactggcattttcacctggaatgattgttcacgttttttattattgaggcatcaaagcccaggaagaaatgtatatgatataacagttttcatcattctatagccattttaactagccaagaggctaactaaaactttaggcatgcttagaatttgtagttgatactaaccaagtatcataaattctgcctttctacttccaaatgtgtatttctacttcatgtaaaatgctatatatttaaccttaatttttgaccaagaaaagatgaattatttagaatagtaaaatatgtcctggtcacaagtccattataatgtaatttgtcatgttacttagttgtatagatttatgctcattttattacacagtcctatttactagtaatatgtccttttgagttagaataataaagattgtatatatgtctaagttttcatttgtagtttatttaatgcttttgtgttttcctttttatttcttgaacaaatcagagaccaggaatgagtggaatgctatcttaagccaaaaaaaactattataatttttatttagtactacttaaatgaagagagataaaaaaagaaacaaaattccaattgataattatcccattcagacattagtgaatatgtcactcaatccaagtcgacctt

SEQ ID NO: 284665 - DNA, 418 bp, Homo sapiens
taaattttaagtttgaagtacttgtttataatgtccaagtaatagaatacagagaccagaacatgggagagaatctgcagctataaatacaaaatttggagttcatcaccactaagtaaaaagaatgcatttctggtttgcattatcaaatacctacgggcaagtgaaaaaagaatgtgacagtgtagccgatcttactcattttcacgtttgcttacagacagctgaaaaagagtacatcaccctaccagatcacccttcacttccttgtcaacctgttctttcttcaggaataactgatatatctttattacaaactgaaagtaagtatagtgcaatcgtaagtacagatgattctgtgaggtaaagtaaataatgttaatggggagttactgtttaatgggtatagagtttcagt

SEQ ID NO: 284666 - DNA, 621 bp, Homo sapiens
cctacaatggttggaagaaaaaatacttggaaacaaagaaagtcacagcatcaatggaggaggttttaacaaaacttcgagaagatttggaactctactataaaaaactgctcatgcaacttgaagccagggagatcaagatgagaccaaagaatctggcaaacatcacagactccaaggtattactaaatgtatcccccttccgttagagaagttctgttcaaaacacatgctttataagtgctagtagtatcacaagatgcattaggctaactttgacttaaacttgcttaaaacaataaaaaaactcatgaccttatgtaataggaggagcattgctgaggagatacagtcagcagcttaatgttgcctttaaggggtctgatattttcttcctattattttcagtgttaatttcattgtaagactgcttctaatagtagcaatagagtggtcaagggcaagtagggctttatatccccaaacagggagaaacctctctctgaatcatggaatatataaatctttccctttatcctaggtaagggatcaactaggcctacccctggatgagaaatagttgccaaggaatgctatatgctgactgacttacagactaat

SEQ ID NO: 284667 - DNA, 1158 bp, Homo sapiens
cgcaagctttgaaaggcgccgtcaagtcaaataaataaatgccctacaacaccaacccaggactgagatctgcatgctggaatgacggtggtggtggtggctttcagtattccccaggttttgtccggagcaccggcacgccctctcttgaagtccgctctccgcacagtggttagacgggaagatccggagctgtccagtgtcttgggtaatgcacggcatcgcctgatgtctgacgctagaacaccacgtaaagtcaagcagagggaagtgaatgcgccctaggcccctgcaggccaccaagaagagctagagggagttggtgcaatcctagagatgccggcaggtgcaccaatctgtggcacacgtacgctctccaatggaagacaactcaagaccacaccaagtttgtattaaaaaagtactgttgtgttactttttaccaacctccaatcattatacaaaatgttaaaaaatacacaaacacacacacacactcacagccatagaggttatcgcaaaagatcaacccagaatctttcagaatatgacagatgcactgagaaggcagataaattgattcaatatacaaaaggcctctttcctatggaatttcattagattaaataaggtgttccctcctcacagcctcatccttatgagcaatcatataaataatctatttaaagtccttgaactataacttgtataatttttagttttccccctttgaaggggcctaagagaaaggtttgagaaaccagctcttgaggggggcaggggtgaggggtaagaggtcctgtgcctttcattcatcctgggagcttctcaggattgcagcatttccacctgagtgttcattcttgtacattttctcatctttctcctgggttcctaggatcttggagattacctagtccaatccttttacttcagaaacaaaaaacctgaggctcagaaaggctaagtcaaatgcctagggtcacacagggaaactgtgggagttggatccctgagtcccagtccttaaactggttgctacatgacattctagaacctctccccaccaactccctttttaaagacagggtctggttctgtcacccaggctgaagtgcagtgacatgatcttgggcgacagaacgagactctgtctca

SEQ ID NO: 284668 - DNA, 712 bp, Homo sapiens
ctgtgcatgtaatgaaatcacctaataatgcatttctccaagcatatccgtgtcattaagtgacatatcttttgtgtgaataatactagattatgtagatatactgtgtttaagcattcatcagctgatgtttggatttttctcacttcttggctattatgaataaatgcttattgaagagttttgaaataaagatgatgaaaagaaggtaaagtatccagaattgttgcttttgtttttttttttgagacacagtctcactctgttgcccaggctggagtgcagtggcgcgttcttggctcactgcaatctccacctcctgggttcaagtgattctcgtatctcagcctcccgagtagctgggatcacaggcatgtgccaccacactcagctaattttttatttttagtgcagacggtgtttcaccatgttggccaggctgctgtcaaactcctggcctcaagcagtccacccgcgtcagcctcccagagtgctgggattacaggcatgagccactgcgcctggccgagaactgcttttcttaatgtttaattacagttaagcaaaaatctaaagggcgattatgccattaatgaaatatccaaagtagtagtgttcttacttaactttatttcatgaggttagcatctaagcccaaattgttaaaagtagaattttggctaaaattccataatttggttgtgttttgcag

SEQ ID NO: 284669 - DNA, 1921 bp, Homo sapiens
agggccaggaagcgcggaaggaaccgccgggggccatggacggagcagtgatggaagggccgctttttttgcagagtcagcgctttgggaccaagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcagcttgggtttaagaagtt

SEQ ID NO: 284670 - DNA, 2001 bp, Homo sapiens
cggccgcgtccttactgaactcggaaatcgctggccggcagcgccagcgctggaatcgcccccgcgcctgggagtggcctcgcgaggccggcgcgcgccccggggccgaggaatccgcctgcccgcccaggcgtcggccacgagagagcgggagcctcgctggtccccatttcagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcagcttgggtttaagaagtt

SEQ ID NO: 284671 - DNA, 1736 bp, Homo sapiens
agggccaggaagcgcggaaggaaccgccgggggccatggacggagcagtgatggaagggccgctttttttgcagagtcagcgctttgggaccaagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcagcttgggtttaagaagtt

SEQ ID NO: 284672 - DNA, 524 bp, Homo sapiens
cggccgcgtccttactgaactcggaaatcgctggccggcagcgccagcgctggaatcgcccccgcgcctgggagtggcctcgcgaggccggcgcgcgccccggggccgaggaatccgcctgcccgcccaggcgtcggccacgagagagcgggagcctcgctggtccccatttcaggtgatgctctacctgggggcggggccacaagcagggaaagaatcccagtggcacctttcatgtgtcccgccgcccttaaggaaccctgcttggtgtgcctgctgtaaacccagtggcgggatgggcccgaggcggcgctgagagagcggccacgatggccgcagtccgcggtgtggactctcttgcagccagcagcgcgtgggatgtgctgtgctcccagagaggattcagggcactaggaaggaggccctccctgtgcctggagcaggagggagcacttcaaaaaggaaatggctttgaaggaggagaaagtcagaaggaagatgtctcaggaaagcaggaacatttg

SEQ ID NO: 284673 - DNA, 1827 bp, Homo sapiens
agggccaggaagcgcggaaggaaccgccgggggccatggacggagcagtgatggaagggccgctttttttgcagagtcagcgctttgggaccaagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcagcttgggtttaagaagtt

SEQ ID NO: 284674 - DNA, 439 bp, Homo sapiens
ctttcttgcctacccggtgaccccgcgtctgttcgcaggtggtctcttctttgtagataccctaactagtgcaggcgtgtgactcacttcctctgatggctcctggtaatgtgtttccccctctaccctccttaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctat

SEQ ID NO: 284675 - DNA, 412 bp, Homo sapiens
ggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcagcttgggttta

SEQ ID NO: 284676 - DNA, 451 bp, Homo sapiens
catagaatattgagaacaggaaagatcagagatgggatgaaaactctgagattgtgaaccagaaagtcatcaagattacctaagagcatcacagattctagctttctcaaaacttgtgaaacacagttgaacattttcaagatttcttggccagtcgcaaatcctcaagcatccaggaaatgaaatgccagaaattcctatattataggaccaaaactgagctcacagactaccttttgaaccttgtactcagaacgacttaggcttctaagtcctgattcttcgtccagaaaacatcattactgaagaccatgcagagaaagtaaccctatagcttagaaaagggagaacatgagaaagcagccaagtgtcactactccatactttctcacaagtctgcagaaattgcttggaaaaataaatgtgcatttcataatgcagaaacctgatt

SEQ ID NO: 284677 - DNA, 697 bp, Homo sapiens
tttttgtgaagtttgggtcatagtacaacctgtgagcagtgaaaaaggaatcctgggcattttgtccctcttgacccgttctctaatctgatggtttggagatttgcagtttaaataaaaggcatagaggaaagtgggatgtgtttatagccctaacttagaatatgtcgattgtaatcatctgaagtatatcacagattggtgtggttaacatagtctctagattagtaaaatactagtttgagcctgagccacgtctgtctatcacctttaccttttactaatataggtagtctttgatgggttcatctgcctttcagattacctaagagcatcacagattctagctttctcaaaacttgtgaaacacagttgaacattttcaagatttcttggccagtcgcaaatcctcaagcatccaggaaatgaaatgccagaaattcctatattataggaccaaaactgagctcacagactaccttttgaaccttgtactcagaacgacttaggcttctaagtcctgattcttcgtccagaaaacatcattactgaagaccatgcagagaaagtaaccctatagcttagaaaagggagaacatgagaaagcagccaagtgtcactactccatactttctcacaagtctgcagaaattgcttggaaaaataaatgtgcatttcataatgcagaaacctgatt

SEQ ID NO: 284678 - DNA, 1411 bp, Homo sapiens
agagccatctttgcgaatttcttggggtgttaatgtaaacatatctttagaatatctcatcgggtttcagtcagagccatgctttgggtttttcctagcagcagtgatgatatcaacttacaaggtttggctttcaggatttcagaagctggcattcaagacaacaggcagtttgtcagagctgaatgagaatcagcctggacaaatcaagtgctttaacaagggcatcttcctctgggaataatcagtccttaatacagtttgcacttgacataatagttttggtaaatgtctttttctggctgcacccccttttaagtaagcctttaattttaaatggtctggaaagatcttcgatgctttctgtaaggtttagtcaccaagaagccagaacttttggtgaaaacagaatttataaaatgaaactgaaccttctcctttcttacaaaataaagatcctgtcagactccagtctcagaccacctttgcccatttgtaattcagacttgcagagtgaggagagaactgcttcagccttactgtcttgtagagagatttggtgaaaatcatgttactttagacccagtagttttcaggaccgcaacaggatgcggggcacctggcttcccgggtaaggtcacatagtctcttaaaattctgtcactaatttttttaaacgactttttttaaaaagccacctcctcatgcctgtccaaaatgaaccacgcaactggttacctttctctgcctaccttttgggctggggaagaggggcacctttctcatcactctcagggaagtcctgaggaactgtgcaagccaggaagcatgagtcgctgaattggtgatggaggggtgtccacttttttctagttcctcagctgcttctggagcagtgttcacaacgggaatgtttttactgtccttggtaggctacaggttcacagcttcaaatcaaggcctccaaggattttattctcttacatcacagttttgacaagtatgcttttaaaaaacaacatttgcaaaactggtctttaagcgacgtgagtcagaggtaacaaaggcatatatataccgaacaaaggtgctccggtgcagtggagagaacagtattagtgtcgcaagcacaggagtgcagacagccccgccttcatcgtgatgcctgcagcacaccacgattatcatgagaggtcaagattttgatttactaatttataatcttatttccaagcaaaacaagtcaatttcatgttacaacttttttcttgtttctttttatcttgtttggcctgagggttgggggatttgggggagttgtcagctgcacaatctttgaagtgtaagttaatttttatgtgatatttcagtatatattttattgattaaatttattggaaaacttaaaatt

SEQ ID NO: 284679 - DNA, 310 bp, Homo sapiens
aagatattctaggccccttgttgcttcagccatcagtctataaataacacaacactaattttccatcaagtaacagcttaaaacagaacactgtcaagattttgatttactaatttataatcttatttccaagcaaaacaagtcaatttcatgttacaacttttttcttgtttctttttatcttgtttggcctgagggttgggggatttgggggagttgtcagctgcacaatctttgaagtgtaagttaatttttatgtgatatttcagtatatattttattgattaaatttattggaaaacttaaaatt

SEQ ID NO: 284680 - DNA, 773 bp, Homo sapiens
ctcggtacccacctcctaccccacgctaatttttttaaacgactttttttaaaaagccacctcctcatgcctgtccaaaatgaaccacgcaactggttacctttctctgcctaccttttgggctggggaagaggggcacctttctcatcactctcagggaagtcctgaggaactgtgcaagccaggaagcatgagtcgctgaattggtgatggaggggtgtccacttttttctagttcctcagctgcttctggagcagtgttcacaacgggaatgtttttactgtccttggtaggctacaggttcacagcttcaaatcaaggcctccaaggattttattctcttacatcacagttttgacaagtatgcttttaaaaaacaacatttgcaaaactggtctttaagcgacgtgagtcagaggtaacaaaggcatatatataccgaacaaaggtgctccggtgcagtggagagaacagtattagtgtcgcaagcacaggagtgcagacagccccgccttcatcgtgatgcctgcagcacaccacgattatcatgagaggtcaagattttgatttactaatttataatcttatttccaagcaaaacaagtcaatttcatgttacaacttttttcttgtttctttttatcttgtttggcctgagggttgggggatttgggggagttgtcagctgcacaatctttgaagtgtaagttaatttttatgtgatatttcagtatatattttattgattaaatttattggaaaacttaaaatt

SEQ ID NO: 284681 - DNA, 787 bp, Homo sapiens
gctcttcggacatggtgtgcgagctgcttggggttcgggggatggacatcctgtacattggggaccacatttttggggacattctcaagtccaagaagcgtcagggctggcggacttgcctggtggttcctgagctgtcctgggagctggacatctgggcccaggagaaggagcggttggaggagctgaagagactggacacgcacctggcagacatataccagcacatggatgggagcagttgtgagctgcaagtcatcaacttcaccaagagagagatccagatgccacatgagtcagttgtggagcaagaacaggccaatctagaccctgcctcctgcctcctctcctgcaaccagaggtctcttccagcaaagagctgtttgtcttctgccatctaggattccaaggaagtgggacactccagtctaggctgttttggtggaaacaacctttgttcagtattgagtagtgcatttacttgtaataatacaaataagtcagctgatgacaatggctgaaagggccaggtcatggaaaccaagaagtgagaagcatttcaggggatgattcttttcttctttttcctatatgtcctggatgatttttactggtacagctagagaagatgaatttaaattcaaaaataatagtaccttctgtggttctgtttgagtcttgcaagatattaagaacaactttccgcaactcttgtattggctggaaggaaggaagaaaacatacaaaatcttataacactgagggggctacaatagaacttcttggc

SEQ ID NO: 284682 - DNA, 874 bp, Homo sapiens
ttaacttggtgtgagaacttttggctgatgaatacaagatacgctcattcattctcttcattgctatgaaatgagtttttccacaacctcctgcagaacctcaacacatcactaggtggcaacatccctacaccatatcggtttagaaaccacggttaggaggagcagcaaaacacgcggcatcccagtatgattcagaagtaaagtttacaatctttgaggcctggctgactcatggaacaactaggacaagaaacaaagacaaagaacacacacctgactggacagagataaaccaagagctgagagttttggaaacaaggctggagctgaggaaaaggactgggaacacgaacctgtacaaacaacaaattcttacaacagaaaacaagccactcctggccatcaagaaacccacaaatctcagaagcaaaagcaaaacaaatgaaaatacaaaccaaatagtctctattaccttcatgcctgttgggtcccaataaaggaatcattccaaaaaaaaataaaaatggcctgcttggctcaacggtggatctcttgggcctttccctttagggaggttatttatgatactagtcattaacttcctcctccgccggtcggttgggggagagtttagccactcaaggcggaatcggtattccatattccggatatcatgtaaaaatgtgaacacagcccccaaagcttaacctcataggccctttttgctttctcttggtccgcccctgacagttcaaaaatagtttcgtcacagtgttaaccccacgctttctatacggcgcttccctggattccctggccgtttcgtcccttccctacagtcccggccgtttctatgagaggggctctaaat

SEQ ID NO: 284683 - DNA, 512 bp, Homo sapiens
ttaacttggtgtgagaacttttggctgatgaatacaagatacgctcattcattctcttcattgctatgaaatgagtttttccacaacctcctgcagaacctcaacacatcactaggtggcaacatccctacaccatatcggtttagaaaccacggttaggaggagcagcaaaacacgcggcatcccagtatgattcagaagtaaagtttacaatctttgaggcctggctgactcatggaacaactaggacaagaaacaaagacaaagaacacacacctgactggacagagataaaccaagagctgagagttttggaaacaaggctggagctgaggaaaaggactgggaacacgaacctgtacaaacaacaaattcttacaacagaaaacaagccactcctggccatcaagaaacccacaaatctcagaagcaaaagcaaaacaaatgaaaatacaaaccaaatagtctctattaccttcatgcctgttgggtcccaataaaggaatcattcc

SEQ ID NO: 284684 - DNA, 773 bp, Homo sapiens
ttaacttggtgtgagaacttttggctgatgaatacaagatacgctcattcattctcttcattgctatgaaatgagtttttccacaacctcctgcagaacctcaacacatcactaggtggcaacatccctacaccatatcggtttagaaaccacggttaggaggagcagcaaaacacgcggcatcccagtatgattcagaagtaaatacaggcaagctgccggagtgaacgctgagtgagggaaaggaacgcaccatcgttatcaaactcgatccgcgtgcatggcccccgggcggtgatgtcgcagctgtacagccctcccgttctgttggctctctgcagtggaagcgcttctgcccgcggggcccccacgagcaacctgttgatgaaacagagacaatttggagatttgaatttaatatacgtttaacagttaaatcagtcagaactaggagatagtgggattattctttgtctaggagtccactaattcttcaacagcttaggcagtgagtgagaacaaatgtagagtcctatggctggttcatgcaaaacgcacaaacacaactaaacaggggaagccaaagaggggataccaaaacgaggaaaataggcctgtctctcatagtatcagcatttcttgctgggtatgatctggtgtttaaaagacaccctcttcaaagaatacaacctctaagcccctatgatgccagggatatcatatgaaactcaagagaagaaaccaaatacttgtgacaatggaaggaaaaaatg

SEQ ID NO: 284685 - DNA, 765 bp, Homo sapiens
cttaaaatttcaccatctcacagcttgacaggctctttagagatccaatgaccttgttgctaggtctcttttgctaacacctttactcaccatcaggtttacaatctttgaggcctggctgactcatggaacaactaggacaagaaacaaagacaaagaacacacacctgactggacagagataaaccaagagctgagagttttggaaacaaggctggagctgaggaaaaggactgggaacacgaacctgtacaaacaacaaattcttacaacagaaaacaagccactcctggccatcaagaaacccacaaatctcagaagcaaaagcaaaacaaatgaaaatacaaaccaaatagtctctattaccttcatgcctgttgggtcccaataaaggaatcattccaaaaaaaaataaaaatggcctgcttggctcaacggtggatctcttgggcctttccctttagggaggttatttatgatactagtcattaacttcctcctccgccggtcggttgggggagagtttagccactcaaggcggaatcggtattccatattccggatatcatgtaaaaatgtgaacacagcccccaaagcttaacctcataggccctttttgctttctcttggtccgcccctgacagttcaaaaatagtttcgtcacagtgttaaccccacgctttctatacggcgcttccctggattccctggccgtttcgtcccttccctacagtcccggccgtttctatgagaggggctctaaat

SEQ ID NO: 284686 - DNA, 6584 bp, Homo sapiens
catttttctcaagacacttcttcagagaaaaatggttctctcagtattcactgtaagctgattgaatgctagatgtggttaatagtacacctggcaacttttacatatatgggtagaataaatagaatagccaacatggtatcaacaaaaagcttcggggtttagactgggaaaattagcatttcatgatatgactgttatgtggaagaatttttgcatttttccatttaagattggctaggaagaaattgtgttcctcctatttaaatcatctctaggtgaagataaccgacaataaagtagtattgtagagtcctgtctcttctgttggaaccagtctactacttcatttcaagaatgtggtctttatatgccctttagattattagaaagagattggctactattcttctttgctgtgtgcttcttttttttttttttgcatgtcttgctgttttgctaatttattgacccccaacctgctctaactcaccttcctcatttctgtcacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggtaataaagcaaccatcatcgtccaaaaacaataaaatggagatgttgccatacctgggacaaaagcctgttaaggcgggttgggagactagctgaccagaacacagcctgtgtgttgtacactgaagaatctgggtgaaaagggaagtggagtgataatgagaatcggtgggctcactgctcccattaggtgaaattactttttttcaaggaattacagtgaaaagttacatctgtgtggcctatatgacttgctcatttgggatttggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaatataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcattccaccactactgtcctctaaccccataaaatcaaaagcggtttttagtttggttattctgataaagcacttagtctaataaagatcaaagcccagcatctgcaagtgaaaattctccttctaacatgatttctgggattttgcagctttctacttaaaaacaaggcacaatagcaagtcaccccatcttccccatatgtgaaatggagatgatgccagtgtcctagggccatcgtacaaatcaagctaagatcatgtacagagaaacaggtagcgcttgaaaagcactcatggtttctctctgatgagtcagtgcctacctggcacagaacaggtagtcaataactgttcgtggaagaacagtttaaaacaaacaaaaacatagttcaagtagaaaaacctttgttataatttgaataaagatcttctctgttaaggcctc

SEQ ID NO: 284687 - DNA, 2500 bp, Homo sapiens
ggaagagctggacatgtttcctcatgccactttatcttttggcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggtaataaagcaaccatcatcgtccaaaaacaataaaatggagatgttgccatacctgggacaaaagcctgttaaggcgggttgggagactagctgaccagaacacagcctgtgtgttgtacactgaagaatctgggtgaaaagggaagtggagtgataatgagaatcggtgggctcactgctcccattaggtgaaattactttttttcaaggaattacagtgaaaagttacatctgtgtggcctatatgacttgctcatttgggatttggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaatataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcattccaccactactgtcctctaaccccataaaatcaaaagcggtttttagtttggttattctgataaagcacttagtctaataaagatcaaagcccagcatctgcaagtgaaaattctccttctaacatgatttctgggattttgcagctttctacttaaaaacaaggcacaatagcaagtcaccccatcttccccatatgtgaaatggagatgatgccagtgtcctagggccatcgtacaaatcaagctaagatcatgtacagagaaacaggtagcgcttgaaaagcactcatggtttctctctgatgagtcagtgcctacctggcacagaacaggtagtcaataactgttcgtggaagaacagtttaaaacaaacaaaaacatagttcaagtagaaaaacctttgttataatttgaataaagatcttctctgttaaggcctc

SEQ ID NO: 284688 - DNA, 295 bp, Homo sapiens
ctgtgattgttttcattcagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcagtttctgatgcagcacacggtgtcccagaagaggggatcatcaagaaccagcgcgca

SEQ ID NO: 284689 - DNA, 10831 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284690 - DNA, 10780 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaacttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284691 - DNA, 10683 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaacttt

SEQ ID NO: 284692 - DNA, 10778 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgcaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284693 - DNA, 11104 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttgagctgtggggtttcatttccagaagattccttcacattctcattggcactattttgagttaagtgcaatttataactggatccctaattcctgggagctcctttgctgtctccttaacttcgaaaggaatagaaacggtcggctgccggctagtactttcagacttccttatctcaggttcacagcttcccaaatgggtctgagccaaaaaataggaagtcactgcttcaagattagccacagcccagcccaaaataatacgtctaaaaaaatt

SEQ ID NO: 284694 - DNA, 10883 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaaacgtttcatattttactcttaaaactactgtgtccaacaacattagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284695 - DNA, 10009 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284696 - DNA, 9845 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcctcccgagtagctgggactacaggcgcccaccacctcgcccggctaattttttgtatttttagtagagacagggtttcaccgtgttagccaggatggtctcgatctcctgaccttgtgatccacctgcctccacctcccaaagtgctgggattccaggcgtgggcaaccgcacccagcttaaggttttttttttggttttgagacggacatcgt

SEQ ID NO: 284697 - DNA, 10372 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284698 - DNA, 10747 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284699 - DNA, 9589 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284700 - DNA, 9049 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaaaataagaacactataaacataaaaacatgt

SEQ ID NO: 284701 - DNA, 9814 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284702 - DNA, 8975 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacagcatatcagggtaccgagctcg

SEQ ID NO: 284703 - DNA, 9826 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagcccaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284704 - DNA, 7811 bp, Homo sapiens
ccttcattttcctccaataagaaatctgttttgccttttctgatggatattaaaaagaaagatttttgctcagtatttgtcatcataaattctcattgctgctgctgccctcaaaaggattgtataaatgagggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284705 - DNA, 7411 bp, Homo sapiens
attctagaggatcccgagctgagaatgtcgcacaagagatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284706 - DNA, 7502 bp, Homo sapiens
tcattccctttggccccactttgagttaaaaaataatgtccttgtttcaaaaagagaaacttcatttttttaataaaataagcaatctaaggcattaacagctagtaaatattaaagctaaaatttgaaaatgtctgttattccaaatccagtgctttcctccctattttgtagctataatcaaagctattcttcaagcatattaattatacagttgataaaatagggtaaggaaaaaagattaaaggaagctattggatctatctgatataggtgccaaagagagagctgatgccaagagatagggaaaagggaatggcagggatgggatggggaaaggaactgtctggatatgttatgtaaatgtctttgtaaagacctattgttggggtgagggagataattgggtgaagagccaatggtaacttgagtattaaaagattggttaatttttcctggtggcaccatcacaaagaacatcagagggaaaacaaatatataatggaaattgatgaatttgggtttgtgcatgtcttgattactaaaatcatcattatttacagacactgaaggctttaggtaaacatgcttccttagaaacatgctgttattgatttgaaataaaactgaatcattgtattttattcttagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284707 - DNA, 7582 bp, Homo sapiens
  misc_feature (298)..(298): n is a, c, g, or t
tcattccctttggccccactttgagttaaaaaataatgtccttgtttcaaaaagagaaacttcatttttttaataaaataagcaatctaaggcattaacagctagtaaatattaaagctaaaatttgaaaatgtctgttattccaaatccagtgctttcctccctattttgtagctataatcaaagctattcttcaagcatattaattatacagttgataaaataggaaaagggaatggcagggatgggatggggaaaggaactgtctggatatgttatgtaaatgtctttgtaaagncctattgtggtaaggaaaaaagattaaaggaagctattggatctatctgatataggtgccaaagagagagctgatgccaagagatagggaaaagggaatggcagggatgggatggggaaaggaactgtctggatatgttatgtaaatgtctttgtaaagacctattgttggggtgagggagataattgggtgaagagccaatggtaacttgagtattaaaagattggttaatttttcctggtggcaccatcacaaagaacatcagagggaaaacaaatatataatggaaattgatgaatttgggtttgtgcatgtcttgattactaaaatcatcattatttacagacactgaaggctttaggtaaacatgcttccttagaaacatgctgttattgatttgaaataaaactgaatcattgtattttattcttagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284708 - DNA, 6900 bp, Homo sapiens
gagcaagtactatttgccatcttcccaacccatacaacatcctcagcagcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284709 - DNA, 7481 bp, Homo sapiens
tttttttaagcctgtctgttttgtttttctttaccttcccagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284710 - DNA, 6402 bp, Homo sapiens
agcgtgttgagtcgcgttggtgtggaggaggtctttcaccagccagcagcagaacagaggtgtggggcctggagctccagccgctcaactcaaactgtatactcagccgtaagccatctcgatggtagcagctcccggagtaggcaccctcctggatctcccgctgcaggccagcagccccgcgcatcagaacgggtgatgcggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284711 - DNA, 5614 bp, Homo sapiens
  misc_feature (6)..(6): n is a, c, g, or t
tacacntcattagtacaccatcagtcacatactcagtacacatcagtcacatactcagtacaccatcagtcagtacaccatcagtcacatcagtccgtacaccatcagtcacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284712 - DNA, 5555 bp, Homo sapiens
cagagaattagcggatctgtgtcgcgtatcggaggaaacggtggggtacagctaaataggttgtagtgatatggttaaaaaatagtagagggatgatgctaataattaggctggtcgctgtatcggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284713 - DNA, 5030 bp, Homo sapiens
cacgctcgggatccgttttgcaccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284714 - DNA, 3296 bp, Homo sapiens
gcatggcttcccagttcatcctcttctcattctgtggcttgccattcatcatcccgtgaagttttccctcttcctgaaattgtaacctaggcttcttttaatgctcgtattctgttgcttataataggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284715 - DNA, 4022 bp, Homo sapiens
  misc_feature (124)..(124): n is a, c, g, or t
  misc_feature (325)..(325): n is a, c, g, or t
  misc_feature (462)..(462): n is a, c, g, or t
  misc_feature (506)..(506): n is a, c, g, or t
  misc_feature (605)..(605): n is a, c, g, or t
gcttcggtgacccggaggccgctttggtaaagtacgggatgtgggatgataggttgccggttagtcgcgaccactcgaccgcctagtcgagcttgtaggctctaacagagctcggtgtccgtancgcgagacatcgtaatggtcatatacggcctcttagataggtatcactcttaaccgtacctctgttaacatgtgaggtagacgaccaacctgagatcacgtagtactcgcagagagtgaaggaagtgtaaagcttatgagctgcgcacgaggtatcgaagtataatacctagtctcgaataagtaggtaattgcggaggancgcatgacaagacgttacgcgcaagcaaggacaatgtaaacttagacatttctataggtgaataactcaatatctcggggtcgaaacggatgacctcccatgacatagttaatttagttgcaccgcgcatgactggnctcctcgcatatgtaccacgggcaagaaagaacagtacctggancgcacaacttcaaataaggcgatagagggcaaggactatacattgctaacgatcagtaaagtcgagatgtgccatatgcgaggaaattgagaaaaagcngcccactagcctttacaggggtaacccatgtgttctaggtccaggagtgcaagccattgtcagtcgttggcgaccaccacaaggcagaacccgcatccgaaaccgtccgtggcagagaatcgccatgagttccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284716 - DNA, 3181 bp, Homo sapiens
  misc_feature (1)..(1): n is a, c, g, or t
  misc_feature (21)..(21): n is a, c, g, or t
  misc_feature (23)..(23): n is a, c, g, or t
nccccccccctcctttgatgncntgccattatgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284717 - DNA, 7414 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaacttt

SEQ ID NO: 284718 - DNA, 9100 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggtaataaagcaaccatcatcgtccaaaaacaataaaatggagatgttgccatacctgggacaaaagcctgttaaggcgggttgggagactagctgaccagaacacagcctgtgtgttgtacactgaagaatctgggtgaaaagggaagtggagtgataatgagaatcggtgggctcactgctcccattaggtgaaattactttttttcaaggaattacagtgaaaagttacatctgtgtggcctatatgacttgctcatttgggatttggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaatataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcattccaccactactgtcctctaaccccataaaatcaaaagcggtttttagtttggttattctgataaagcacttagtctaataaagatcaaagcccagcatctgcaagtgaaaattctccttctaacatgatttctgggattttgcagctttctacttaaaaacaaggcacaatagcaagtcaccccatcttccccatatgtgaaatggagatgatgccagtgtcctagggccatcgtacaaatcaagctaagatcatgtacagagaaacaggtagcgcttgaaaagcactcatggtttctctctgatgagtcagtgcctacctggcacagaacaggtagtcaataactgttcgtggaagaacagtttaaaacaaacaaaaacatagttcaagtagaaaaacctttgttataatttgaataaagatcttctctgttaaggcctc

SEQ ID NO: 284719 - DNA, 7116 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatacccattacaatttccagcattccccctcaaccct

SEQ ID NO: 284720 - DNA, 7205 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgaggtaagtctctcttttgccgcagagaatccgtaacacacatctgagtcaaggtgatagaaacaactaagctgctgcttaacgtcttacgccacgaccttcttcaattttaatactttagaaaaacaaggcaaaaatcccccaggtacccttttatttttccttccctgaattcctaac

SEQ ID NO: 284721 - DNA, 7030 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaaggtagagccgagagacaaggtagagccgagagacaaggtagagccgagagacaaggtagagccgag

SEQ ID NO: 284722 - DNA, 6990 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctgcccccatctctgcagcatcagctacctctctaggtcacttcaccaagtctatgtgcccccgccctccacgcgccgggcgcg

SEQ ID NO: 284723 - DNA, 2316 bp, Homo sapiens
tactactactaaattcgcggctgcgtcgacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284724 - DNA, 2302 bp, Homo sapiens
gtttgtttgtttttgagacagagtcttactctgtcacccaggctggagtgcagtggcgacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284725 - DNA, 5336 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctacccggtgcaaaacgggcccagtc

SEQ ID NO: 284726 - DNA, 1728 bp, Homo sapiens
cgcggccccagtgtagactaatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284727 - DNA, 1580 bp, Homo sapiens
gattatagaggatcccctgcaaacggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatcatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttaataagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284728 - DNA, 3969 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcaacctcaagctccacaagtcttgcctcaagtatcagctggaaaacagagtactcagggagtctctcaggttgctcctgcagagccagttgcagtagcacagccccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcatccctaccagttcatctcctccgttgactacaacccctaacacggata

SEQ ID NO: 284729 - DNA, 2418 bp, Homo sapiens
ggcgggatccgagcgggctgtgtggaggcttcagactcccggcgccatttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtgccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgcgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtatgtttcaggtgtaccttggagcctgactggctttctgacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaacctaatg

SEQ ID NO: 284730 - DNA, 568 bp, Homo sapiens
atgctgcggtcgttctagaggatcccgtgtgtacgagataggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 284731 - DNA, 309 bp, Homo sapiens
ggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatgtacgtatcttgggaagtggacagataggctaatgattctcctaattggtttttttagcttcttgttattttgcactggctttttggt

SEQ ID NO: 284732 - DNA, 519 bp, Homo sapiens
gtaaattctacagtgcctctgctatgttgaaagcttaatcataaagcagtaatttatgatgacacagataataaaaaagaatagaaaactgaagttataaccaacagataaacatatgggagagggaaatagatgaagaatacagagaattacagaaaaagccaagaagcacggccataccaagatatagtctgtataatagatattgtagtatgtgtttatttctgcacttagtactgttgtctatgttttaagattactccatattttttatcaaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaacacagcacctccaaactttagtcataca

SEQ ID NO: 284733 - DNA, 524 bp, Homo sapiens
atttgctattaatttaagaccttagtctgaggttgtttagcctccccagttactctctggccttcaagctcttttcattgttagagattactgtgatactgggggagaagggtacaagtaaacttaaaaggagtgtcaagttatcagactttgtaaagatgttgaagttttaaatgggaaagcccttttgagctttgctgtaaagccgctgtattgtgctctctttcaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccc

SEQ ID NO: 284734 - DNA, 500 bp, Homo sapiens
acctgacaggtgcgcggcccgggccggctgggctctcagagccgagaggtggggccccgacctggccgtggggctgggcccgctccgtcgccccgaccccgcgtggtccgccaactccctcctgcgcgcggagaggacgggcattgttctcggggccccggagagcgcgagagcggcctgagcctggaggccatcctgcctgagattctacccttagagcttcattcttttgtgactttcacacctttcagaaacttggagaaagatctgcccccaggtgaggtttgggtaactcctccactcccatccccacctcagaggaggcttgctccacctccactgcccctcaggcccaagctcctgtctgggtcctcagcctctgtggagttgaggtctgtagcatatctcaagggcactggggaggtgccgctgccctgcatcctcccaaaccccacagctcctctcaccccttttggtctcccttttgccccccacctcca

SEQ ID NO: 284735 - DNA, 530 bp, Homo sapiens
actatgagccaggataaacacattactctcttctttaacaaaaagagcatggttaactccaaagacttctctagaccagcctggatggtacctaaactttaatcaaccaatgctcaagtaaaagagcagtatccagccccagcacacctaactgttttgcataacatagtgctcctgactggagagcccaggctgagatggtgttaaatgcttttaccacgtgggctcctggcaccaaatgagcaagatctcaccccacaggccttggaaacctgaggcagtattcttctgggatgtttccaactaggcttcccatgaggatgttagagccagcctggctggtgaattttacttctctcacctctcagaggtaagaggtctgagaggctcaggcccttccagcttttgaggattccagcatagtagaaacataaaaaggtccaaagggaattacaaaaataatctattttcagttcttatacttaacaagtcaattcttattaaaaaaataaatcaatcaaacttttgtt

SEQ ID NO: 284736 - DNA, 801 bp, Homo sapiens
  misc_feature (45)..(45): n is a, c, g, or t
  misc_feature (91)..(91): n is a, c, g, or t
  misc_feature (179)..(179): n is a, c, g, or t
  misc_feature (250)..(250): n is a, c, g, or t
  misc_feature (310)..(310): n is a, c, g, or t
  misc_feature (390)..(390): n is a, c, g, or t
  misc_feature (757)..(757): n is a, c, g, or t
  misc_feature (774)..(774): n is a, c, g, or t
  misc_feature (793)..(793): n is a, c, g, or t
  misc_feature (797)..(798): n is a, c, g, or t
ctcctctctccacaatttccaggccaggccaacccaggggacaangcaggcctccctgaaagcccaccctctccccagtccctatcacctnaaggatcatgcctgcacaccccgcttctctctcggatgcagtagcactgcactgggcatcagagggcataggactgagcataagctcngcttggcttctaactgactgagggattttggacaagtcacctccctactctgagcttcaatttggccaccngtaaaacatgagagttgaacttcatttcgaatcgtgggaatctgggtttgagctggggantgtggggttggccatgggtgttcttcttggtgaacagagcaaggagcagagtagagacccctaggagatattactggtcnagaagagaagatgtatgtgtatttgctatgagtgtatttatgatcatatatagtatgtgacgtgtacatatacatgtggaagcataaatacacatgtaagggtgtgtgtgtgtttttgtgtgtgtgtgtttacggcagcagctaattgatccctgcctcccagttgctgtgggggaaggggccgagaaggcagtcactcattagaggcaactaatgggcccaaatggccttgtcagcaaaggctgagcttagatgagcttcctcccgaagtggggaaggaaaaagatgtgaaatagaaaaaggaggggagaagagagcaaagaaggcgggcagaggcctcagaaagaatgaggcttccccaggaganactacaaggattgcagnatcctcactttatccctgnaatnnata

SEQ ID NO: 284737 - DNA, 1035 bp, Homo sapiens
atgtaagtggaatcccacagctgcacccttttgtatctggctgcttttgttcagcatagtgtttttgagattcatctatattgatgccactatcattagtgtatacctctcattgtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284738 - DNA, 721 bp, Homo sapiens
agcggggacgcgccggcgctgcggcgttggcgcagtcgtgggaacagcgcggagcagagaagcaccaaaagaggcaaactgagatgcagacaaatgatcatccgtatgctgatcattttgaatagttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggtaaggagtaaaatttcccaagcaagacca

SEQ ID NO: 284739 - DNA, 2283 bp, Homo sapiens
agcggggacgcgccggcgctgcggcgttggcgcagtcgtgggaacagcgcggagcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284740 - DNA, 1710 bp, Homo sapiens
agcggggacgcgccggcgctgcggcgttggcgcagtcgtgggaacagcgcggagcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacaggtctgtatttcaggggcccagacagtttaagattccaaagttaatagagagagggtgtgaattaatcatggatgcgccccctctgtaacaaagcattactaactgcttcacttggcgtgctgcactaaataattatgttgtctaatagagggcacagaaagggagtggtttgaaggaaaaacagaagcagctcaaactagaaatgttcatctgttgcagtgcacaagagttcactctgtggctggactggtttatctggaaatgaccattctctaagagagcacagctacagtgctaagggactttttccctgtgctgaaaagattgcattgtgttacgtgaaacctctctttgaagtcaaccctctaccttaaactgttgattaaaaggctacttccctaaaaacctactcagtgcatccgttcagggcctttgtattctccctcaccattttggccaggaattaccacacagacatttgtagttattttcaaaatagcagcttttcccagataatgttcctgggtagtagggaaggaaaaggaattaaaataattaaagagatgactg

SEQ ID NO: 284741 - DNA, 2466 bp, Homo sapiens
agcggggacgcgccggcgctgcggcgttggcgcagtcgtgggaacagcgcggagcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284742 - DNA, 2558 bp, Homo sapiens
agcggggacgcgccggcgctgcggcgttggcgcagtcgtgggaacagcgcggagcaggtaacggccccgctgctgccgtcgtccccctcagccggttaccctgttacagccccagctctgggcccttccggaccctcctgctacgctctttctgggcttccagtatcgccggtcactcagtcctcgcccctgcctgcctctctggcgccccgccgtttcctcctcgcggcacagtttgccaaggaacagctaccccggctcggcagtgaccgggcgctccggcgacacacgtactctcaggcccgctgggcagggggacggcctgggccgaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284743 - DNA, 2350 bp, Homo sapiens
agcggggacgcgccggcgctgcggcgttggcgcagtcgtgggaacagcgcggagcagagaagcaccaaaagaggcaaactgagatgcagacaaatgatcatccgtatgctgatcattttgaatagttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284744 - DNA, 2490 bp, Homo sapiens
agcggggacgcgccggcgctgcggcgttggcgcagtcgtgggaacagcgcggagcagagaagcaccaaaagaggcaaactgagatgcagacaaatgatcatccgtatgctgatcattttgaataccttcagccatgcttctgccactgcctctgcaggaaagccacctgctttaaaaaaaagtcttcatggagtgcttatgagagggtcggctgttttctccagctcatttttccaaagcaaacaatcccaccagctatctcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284745 - DNA, 2608 bp, Homo sapiens
agcggggacgcgccggcgctgcggcgttggcgcagtcgtgggaacagcgcggagcaggtaacggccccgctgctgccgtcgtccccctcagccggttaccctgttacagccccagctctgggcccttccggaccctcctgctacgctctttctgggcttccagtatcgccggtcactcagtcctcgcccctgcctgcctctctggcgccccgccgtttcctcctcgcggcacagtttgccaaggaacagctaccccggctcggcagtgaccgggcgctccggcgacacacgtactctcaggcccgctgggcagggggacggcctgggccgagtctgtcagcactgccttcaaaatgcacccagaatagattcgcaattctaccatttctctcaaccgccactgtcaccaccttggtccaggcccccatcatctgagaagcaccaaaagaggcaaactgagatgcagacaaatgatcatccgtatgctgatcattttgaataatgaaaagcggaatctaatttgcatttcattatgagagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284746 - DNA, 2445 bp, Homo sapiens
agcggggacgcgccggcgctgcggcgttggcgcagtcgtgggaacagcgcggagcaggtaacggccccgctgctgccgtcgtccccctcagccggttaccctgttacagccccagctctgggcccttccggaccctcctgctacgctctttctgggcttccagtatcgccggtcactcagtcctcgcccctgcctgcctctctggcgccccgccgtttcctcctcgcggcacagtttgccaaggaacagctaccccggctcggcagtgaccgggcgctccggcgacacacgtactctcaggcccgctgggcagggggacggcctgggccgagagaagcaccaaaagaggcaaactgagatgcagacaaatgatcatccgtatgctgatcattttgaataagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284747 - DNA, 1951 bp, Homo sapiens
agcggggacgcgccggcgctgcggcgttggcgcagtcgtgggaacagcgcggagcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284748 - DNA, 2371 bp, Homo sapiens
agcggggacgcgccggcgctgcggcgttggcgcagtcgtgggaacagcgcggagcagagaagcaccaaaagaggcaaactgagatgcagacaaatgatcatccgtatgctgatcattttgaatagttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttttacttttcttttattaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284749 - DNA, 1920 bp, Homo sapiens
agcggggacgcgccggcgctgcggcgttggcgcagtcgtgggaacagcgcggagcagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284750 - DNA, 1624 bp, Homo sapiens
agcggggacgcgccggcgctgcggcgttggcgcagtcgtgggaacagcgcggagcagagaagcaccaaaagaggcaaactgagatgcagacaaatgatcatccgtatgctgatcattttgaatagcaagaaacacataatccaaaaactttaattatttatgttcaactctgtactggaaagaaagagcaggcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284751 - DNA, 2635 bp, Homo sapiens
agcggggacgcgccggcgctgcggcgttggcgcagtcgtgggaacagcgcggagcagtctgtcagcactgccttcaaaatgcacccagaatagattcgcaattctaccatttctctcaaccgccactgtcaccaccttggtccaggcccccatcatctgagaagcaccaaaagaggcaaactgagatgcagacaaatgatcatccgtatgctgatcattttgaatagttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284752 - DNA, 2502 bp, Homo sapiens
agcggggacgcgccggcgctgcggcgttggcgcagtcgtgggaacagcgcggagcagagaagcaccaaaagaggcaaactgagatgcagacaaatgatcatccgtatgctgatcattttgaataagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284753 - DNA, 1893 bp, Homo sapiens
agcggggacgcgccggcgctgcggcgttggcgcagtcgtgggaacagcgcggagcagagaagcaccaaaagaggcaaactgagatgcagacaaatgatcatccgtatgctgatcattttgaatagagaattgagaattaaatgaaaaggtaaatccttttaaagacctcagaagatggatctgtttgtttcaatctgcttttgaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaacttggcgaaatttttaaggccgtggggaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaacaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtca

SEQ ID NO: 284754 - DNA, 999 bp, Homo sapiens
agcggggacgcgccggcgctgcggcgttggcgcagtcgtgggaacagcgcggagcaggtaacggccccgctgctgccgtcgtccccctcagccggttaccctgttacagccccagctctgggcccttccggaccctcctgctacgctctttctgggcttccagtatcgccggtcactcagtcctcgcccctgcctgcctctctggcgccccgccgtttcctcctcgcggcacagtttgccaaggaacagctaccccggctcggcagtgaccgggcgctccggcgacacacgtactctcaggcccgctgggcagggggacggcctgggccgagtctgtcagcactgccttcaaaatgcacccagaatagattcgcaattctaccatttctctcaaccgccactgtcaccaccttggtccaggcccccatcatctgagaagcaccaaaagaggcaaactgagatgcagacaaatgatcatccgtatgctgatcattttgaatagcaagaaacacataatccaaaaactttaattatttatgttcaactctgtactggaaagaaagagcaggcaggtgagccacaagatcttttctgccaaaaacttgaaaaggcactgctgtgtatggctccttcaaatcttacttcaacatcactgtttgataatcacatccaagaatttcccaatcaactgccaacaggtgattcactttcatagagaaaaagccgcctgtggccaggtgcagtagctcacacctgtaatcccagcactttgggaggccaaggtgagtagatcacttgaggtcaggagtttgagaccagcctggccaacatgggtaaaaccccgtctgtactaaaaatacaaaaaatttagccgggcatggtggcgggcgctgtaatcccagctactcaggaggctgaggcaggagaattgcttgaacctgggaggcagaggttgcagtgagccaagaccacaccaatccataatacaagggaatatat

SEQ ID NO: 284755 - DNA, 509 bp, Homo sapiens
ctgatggtaaactcagctgactgatgtctggcaaagggatatttaatctgcttccaacagtctggaataaagatctcgtgactctcactgaggatgtttcagcagtgttactctggggacagtctctgccctgtctctctctccacggccacactcctacctactgtagcaaccagcaccaagtcttgaaccagctcctgcttctggatgacaaggatgcaagtggccacgttgggaaggtccacatggcaagaactgaggatggcctccagccaaaatccaggaagaaaccgaggccctcaatccaataacacacaagtaactgaatgctgtcaacaccacatgagcttagaagcagatccttccccagctgagcctccaatgagattgcagccccagctgacacctttgttgcacctttataagaccctgaagcagagaacccagctaaaccatgtccagtctcctaacccacagaaaatgagataataaatatgtgccactttaag

SEQ ID NO: 284756 - DNA, 1907 bp, Homo sapiens
ggcgcatacgcggtgcggccgctgcttcaggtcggcgggctccagggagacctgggtgggcagcgtcgccgtttctcctttcttgggcagtatttttcccagcgccacgcggaggctgggccattatgagctctgcatttccaggacctggtcactattcaggacacggttccagcgcagtgcgcgttagccatgtctcagggatgagtgacattccaagatgtggccattgacttctccaaggaagagtggggattcctgaaccctgctcagagagatttgtacacaactgtgatgctggagaattatcagaacctggtctggctgggactttccatttctaaatctgtgatttcactgttggagaaaaggaaactgccttggataatggcaaaagaagagataagaggcccattgccagatgtgccaggtgcagagattaaggagttatctgcaaagagggctattaatgaagtattatcgcagtttgacacagtgataaaatgtacaagaaacgtatgtaaggaatgtggaaatctatactgccacaatatgcagcttactctccataagagaaatcatacacaaaagaaatgcaatcagtgtttagattgtgggaaatacttcactcgtcaatcaactctcattcagcatcaaagaatccacacgggagagagaccctataaatgtaacgaatgtattaaaaccttcaaccagagggcacaccttacctagcatgagagaattcacactggtgagaaaccttacaaatgtaaggaatgcaggaaaaccttcagccagatgactcatctcacacagcatcagactacacatacgagagaaaagttccatgaatgcagtgaatgtggaaaggccttcagccgtgtctcagctcttatagatcaccagcgaattcatagtggagaaaagccgtatgaatgtaaggagtgtggaagagccttcactcaaagtgcccagctcattagacatcagaaaactcattctggagaaaaaccctatgagtgtagtaagtgtaagaaatcttttgtgcacctgtcttccctgattgaacattggagaattcacactggagaaaaaccatatcaatgtaaggactgcaaaaagaccttttgtcgtgtgatgcagttcactctgcacaggagaattcatactggtgaaaaaccctatgaatgcaaggaatgtggaaagtccttcagcgcccattcttctcttgttactcataagagaacacacagtggagaaaaaccgtataaatgcaaggaatgtggaaaagccttcagtgcgcactcttcccttgttactcataagagaacacacagtggagagaaaccctatacatgccatgcctgtgggaaggcctttaatacttcctccacactttgtcaacataatagaattcatactggtgaaaaaccctttcagtgcagtcaatgcgggaagtcctttagctgcagctctcaccttactcgacactgtagaatgtgtaatggaaaatttagcaaataaccaaaactcaaaatgttaattctgattattctgtatcatcaccagtactttgtactttgagtctttttaaatatgctctgttagtttgtatggaatgatatttcattgcacttttaatttaacttaaaaatgccttcccttgactgttgatatgtattttttgtgaagtgtgtgttgaagccttgcagattattttttaaattagaggtttatcactaggtatatctcctaatgctatccctcccccctccccctaatgtaaatgacgagttaatggtgcagcacaccaacatggcacatgtatacatatgtaacaaacctgcacgttgtgcacatggtaccctaaaacttaaagtataattaaaaaaaaaaattagagg

SEQ ID NO: 284757 - DNA, 1979 bp, Homo sapiens
ggcgcatacgcggtgcggccgctgcttcaggtcggcgggctccagggagacctgggtgggcagcgtcgccgtttctcctttcttgggcagtatttttcccagcgccacgcggaggctgggccattatgagctctgcatttccaggacctggtcactattcaggacacggttccagcgcagtgcgcgttagccatgtctcagggatgagtgacattccaagatgtggccattgacttctccaaggaagagtggggattcctgaaccctgctcagagagatttgtacacaactgtgatgctggagaattatcagaacctggtctggctgggactttccatttctaaatctgtgatttcactgttggagaaaaggaaactgccttggataatggcaaaagaagagataagaggcccattgccaggatatttcaaggtgtcagagatgaccatctcccaggagccaaaggcaaagactagaactctctttggaaaagatgtgccaggtgcagagattaaggagttatctgcaaagagggctattaatgaagtattatcgcagtttgacacagtgataaaatgtacaagaaacgtatgtaaggaatgtggaaatctatactgccacaatatgcagcttactctccataagagaaatcatacacaaaagaaatgcaatcagtgtttagattgtgggaaatacttcactcgtcaatcaactctcattcagcatcaaagaatccacacgggagagagaccctataaatgtaacgaatgtattaaaaccttcaaccagagggcacaccttacctagcatgagagaattcacactggtgagaaaccttacaaatgtaaggaatgcaggaaaaccttcagccagatgactcatctcacacagcatcagactacacatacgagagaaaagttccatgaatgcagtgaatgtggaaaggccttcagccgtgtctcagctcttatagatcaccagcgaattcatagtggagaaaagccgtatgaatgtaaggagtgtggaagagccttcactcaaagtgcccagctcattagacatcagaaaactcattctggagaaaaaccctatgagtgtagtaagtgtaagaaatcttttgtgcacctgtcttccctgattgaacattggagaattcacactggagaaaaaccatatcaatgtaaggactgcaaaaagaccttttgtcgtgtgatgcagttcactctgcacaggagaattcatactggtgaaaaaccctatgaatgcaaggaatgtggaaagtccttcagcgcccattcttctcttgttactcataagagaacacacagtggagaaaaaccgtataaatgcaaggaatgtggaaaagccttcagtgcgcactcttcccttgttactcataagagaacacacagtggagagaaaccctatacatgccatgcctgtgggaaggcctttaatacttcctccacactttgtcaacataatagaattcatactggtgaaaaaccctttcagtgcagtcaatgcgggaagtcctttagctgcagctctcaccttactcgacactgtagaatgtgtaatggaaaatttagcaaataaccaaaactcaaaatgttaattctgattattctgtatcatcaccagtactttgtactttgagtctttttaaatatgctctgttagtttgtatggaatgatatttcattgcacttttaatttaacttaaaaatgccttcccttgactgttgatatgtattttttgtgaagtgtgtgttgaagccttgcagattattttttaaattagaggtttatcactaggtatatctcctaatgctatccctcccccctccccctaatgtaaatgacgagttaatggtgcagcacaccaacatggcacatgtatacatatgtaacaaacctgcacgttgtgcacatggtaccctaaaacttaaagtataattaaaaaaaaaaattagagg

SEQ ID NO: 284758 - DNA, 1966 bp, Homo sapiens
ggcgcatacgcggtgcggccgctgcttcaggtcggcgggctccagggagacctgggtgggcagcgtcgccgtttctcctttcttgggcagtatttttcccagcgccacgcggaggctgggccattatgagctctgcatttccaggacctggtcactattcaggacacggttccagcgcagtgcgcgttagccatgtctcagctccagactgagaggacgcagcatagaaaatgcttatgagtggttcagactcagtaatgggatgagtgacattccaagatgtggccattgacttctccaaggaagagtggggattcctgaaccctgctcagagagatttgtacacaactgtgatgctggagaattatcagaacctggtctggctgggactttccatttctaaatctgtgatttcactgttggagaaaaggaaactgccttggataatggcaaaagaagagataagaggcccattgccagatgtgccaggtgcagagattaaggagttatctgcaaagagggctattaatgaagtattatcgcagtttgacacagtgataaaatgtacaagaaacgtatgtaaggaatgtggaaatctatactgccacaatatgcagcttactctccataagagaaatcatacacaaaagaaatgcaatcagtgtttagattgtgggaaatacttcactcgtcaatcaactctcattcagcatcaaagaatccacacgggagagagaccctataaatgtaacgaatgtattaaaaccttcaaccagagggcacaccttacctagcatgagagaattcacactggtgagaaaccttacaaatgtaaggaatgcaggaaaaccttcagccagatgactcatctcacacagcatcagactacacatacgagagaaaagttccatgaatgcagtgaatgtggaaaggccttcagccgtgtctcagctcttatagatcaccagcgaattcatagtggagaaaagccgtatgaatgtaaggagtgtggaagagccttcactcaaagtgcccagctcattagacatcagaaaactcattctggagaaaaaccctatgagtgtagtaagtgtaagaaatcttttgtgcacctgtcttccctgattgaacattggagaattcacactggagaaaaaccatatcaatgtaaggactgcaaaaagaccttttgtcgtgtgatgcagttcactctgcacaggagaattcatactggtgaaaaaccctatgaatgcaaggaatgtggaaagtccttcagcgcccattcttctcttgttactcataagagaacacacagtggagaaaaaccgtataaatgcaaggaatgtggaaaagccttcagtgcgcactcttcccttgttactcataagagaacacacagtggagagaaaccctatacatgccatgcctgtgggaaggcctttaatacttcctccacactttgtcaacataatagaattcatactggtgaaaaaccctttcagtgcagtcaatgcgggaagtcctttagctgcagctctcaccttactcgacactgtagaatgtgtaatggaaaatttagcaaataaccaaaactcaaaatgttaattctgattattctgtatcatcaccagtactttgtactttgagtctttttaaatatgctctgttagtttgtatggaatgatatttcattgcacttttaatttaacttaaaaatgccttcccttgactgttgatatgtattttttgtgaagtgtgtgttgaagccttgcagattattttttaaattagaggtttatcactaggtatatctcctaatgctatccctcccccctccccctaatgtaaatgacgagttaatggtgcagcacaccaacatggcacatgtatacatatgtaacaaacctgcacgttgtgcacatggtaccctaaaacttaaagtataattaaaaaaaaaaattagagg

SEQ ID NO: 284759 - DNA, 1400 bp, Homo sapiens
ggcgcatacgcggtgcggccgctgcttcaggtcggcgggctccagggagacctgggtgggcagcgtcgccgtttctcctttcttgggcagtatttttcccagcgccacgcggaggctgggccattatgagctctgcatttccaggacctggtcactattcaggacacggttccagcgcagtgcgcgttagccatgtctcagggatgagtgacattccaagatgtggccattgacttctccaaggaagagtggggattcctgaaccctgctcagagagatttgtacacaactgtgatgctggagaattatcagaacctggtctggctgggactttccatttctaaatctgtgatttcactgttggagaaaaggaaactgccttggataatggcaaaagaagagataagaggcccattgccagatgtgccaggtgcagagattaaggagttatctgcaaagagggctattaatgaagtattatcgcagtttgacacagtgataaaatgtacaagaaacgtatgtaaggaatgtggaaatctatactgccacaatatgcagcttactctccataagagaaatcatacacaaaagaaatgcaatcagtgtttagattgtgggaaatacttcactcgtcaatcaactctcattcagcatcaaagaatccacacgggagagagaccctataaatgtaacgaatgtattaaaaccagcgcccattcttctcttgttactcataagagaacacacagtggagaaaaaccgtataaatgcaaggaatgtggaaaagccttcagtgcgcactcttcccttgttactcataagagaacacacagtggagagaaaccctatacatgccatgcctgtgggaaggcctttaatacttcctccacactttgtcaacataatagaattcatactggtgaaaaaccctttcagtgcagtcaatgcgggaagtcctttagctgcagctctcaccttactcgacactgtagaatgtgtaatggaaaatttagcaaataaccaaaactcaaaatgttaattctgattattctgtatcatcaccagtactttgtactttgagtctttttaaatatgctctgttagtttgtatggaatgatatttcattgcacttttaatttaacttaaaaatgccttcccttgactgttgatatgtattttttgtgaagtgtgtgttgaagccttgcagattattttttaaattagaggtttatcactaggtatatctcctaatgctatccctcccccctccccctaatgtaaatgacgagttaatggtgcagcacaccaacatggcacatgtatacatatgtaacaaacctgcacgttgtgcacatggtaccctaaaacttaaagtataattaaaaaaaaaaattagagg

SEQ ID NO: 284760 - DNA, 1660 bp, Homo sapiens
ggcgcatacgcggtgcggccgctgcttcaggtcggcgggctccagggagacctgggtgggcagcgtcgccgtttctcctttcttgggcagtatttttcccagcgccacgcggaggctgggccattatgagctctgcatttccaggacctggtcactattcaggacacggttccagcgcagtgcgcgttagccatgtctcagggatgagtgacattccaagatgtggccattgacttctccaaggaagagtggggattcctgaaccctgctcagagagatttgtacacaactgtgatgctggagaattatcagaacctggtctggctgggactttccatttctaaatctgtgatttcactgttggagaaaaggaaactgccttggataatggcaaaagaagagataagaggcccattgccagatgtgccaggtgcagagattaaggagttatctgcaaagagggctattaatgaagtattatcgcagtttgacacagtgataaaatgtacaagaaacgtatgtaaggaatgtggaaatctatactgccacaatatgcagcttactctccataagagaaatcatacacaaaagaaatgcaatcagtgtttagattgtgggaaatacttcactcgtcaatcaactctcattcagcatcaaagaatccacacgggagagagaccctataaatgtaacgaatgtattaaaaccttcaaccagagggcacaccttacctagcatgagagaattcacactggtgagaaaccttacaaatgtaaggaatgcaggaaaaccttcagccagatgactcatctcacacagcatcagactacacatacgagagaaaagttccatgaatgcagtgaatgtggaaaggccttcagccgtgtctcagctcttatagatcaccagcgaattcatagtggagaaaagccgtatgaatgtaaggagtgtggaagagccttcactcaaagtgcccagctcattagacatcagaaaactcattctggagaaaaaccctatgagtgtagtaagtgtaagaaatcttttgtgcacctgtcttccctgattgaacattggagaattcacactggagaaaaaccatatcaatgtaaggactgcaaaaagaccttttgtcgtgtgatgcagttcactctgcacaggagaattcatactggtgaaaaaccctatgaatgcaaggaatgtggaaagtcctttcctttagctgcagctctcaccttactcgacactgtagaatgtgtaatggaaaatttagcaaataaccaaaactcaaaatgttaattctgattattctgtatcatcaccagtactttgtactttgagtctttttaaatatgctctgttagtttgtatggaatgatatttcattgcacttttaatttaacttaaaaatgccttcccttgactgttgatatgtattttttgtgaagtgtgtgttgaagccttgcagattattttttaaattagaggtttatcactaggtatatctcctaatgctatccctcccccctccccctaatgtaaatgacgagttaatggtgcagcacaccaacatggcacatgtatacatatgtaacaaacctgcacgttgtgcacatggtaccctaaaacttaaagtataattaaaaaaaaaaattagagg

SEQ ID NO: 284761 - DNA, 1459 bp, Homo sapiens
ggcgcatacgcggtgcggccgctgcttcaggtcggcgggctccagggagacctgggtgggcagcgtcgccgtttctcctttcttgggcagtatttttcccagcgccacgcggaggctgggccattatgagctctgcatttccaggacctggtcactattcaggacacggttccagcgcagtgcgcgttagccatgtctcagctccagactgagaggacgcagcatagaaaatgcttatgagtggttcagactcagtaatgggatgagtgacattccaagatgtggccattgacttctccaaggaagagtggggattcctgaaccctgctcagagagatttgtacacaactgtgatgctggagaattatcagaacctggtctggctgggactttccatttctaaatctgtgatttcactgttggagaaaaggaaactgccttggataatggcaaaagaagagataagaggcccattgccagatgtgccaggtgcagagattaaggagttatctgcaaagagggctattaatgaagtattatcgcagtttgacacagtgataaaatgtacaagaaacgtatgtaaggaatgtggaaatctatactgccacaatatgcagcttactctccataagagaaatcatacacaaaagaaatgcaatcagtgtttagattgtgggaaatacttcactcgtcaatcaactctcattcagcatcaaagaatccacacgggagagagaccctataaatgtaacgaatgtattaaaaccagcgcccattcttctcttgttactcataagagaacacacagtggagaaaaaccgtataaatgcaaggaatgtggaaaagccttcagtgcgcactcttcccttgttactcataagagaacacacagtggagagaaaccctatacatgccatgcctgtgggaaggcctttaatacttcctccacactttgtcaacataatagaattcatactggtgaaaaaccctttcagtgcagtcaatgcgggaagtcctttagctgcagctctcaccttactcgacactgtagaatgtgtaatggaaaatttagcaaataaccaaaactcaaaatgttaattctgattattctgtatcatcaccagtactttgtactttgagtctttttaaatatgctctgttagtttgtatggaatgatatttcattgcacttttaatttaacttaaaaatgccttcccttgactgttgatatgtattttttgtgaagtgtgtgttgaagccttgcagattattttttaaattagaggtttatcactaggtatatctcctaatgctatccctcccccctccccctaatgtaaatgacgagttaatggtgcagcacaccaacatggcacatgtatacatatgtaacaaacctgcacgttgtgcacatggtaccctaaaacttaaagtataattaaaaaaaaaaattagagg

SEQ ID NO: 284762 - DNA, 1164 bp, Homo sapiens
tgacttgaactaaaaacaattcaaaccactgggtcatgcacagtcaataagttaaaaaactataagaaaaaaaggcataagggcatgagtggaaaataaaccctatttaactaaggggtagggagtgggagcaagaaaaccacttagtattttgtatagaatggggaagagaggaagatattttcattatggctttaggatggaagcgcttcagatagtcccctgccccattcctccaaatcaaagccccagtggcagtgacagtaccaggaaacaatctagcctccccgcccaccccgcccccataaccgtgcccggcggctgctgtccagtcgcccgtgcttcccaaggctgccgaggaagcggctgctgctcattccagtagatccaacgcccaggctagggggtagagacacagcccttgtggtagggtagggcacgtcttcggcccaccgctcctgggcgccagtggcttcaagggaagaccttgggacctggatagggttctccctcgcaccagaagtcatcggcctgtggggtctccaggagccacacctctcgaggcaggtcacaggccgagctggaggcctccttgggcctgaccggctccagcacccggtaatagtggcagtcccggccatcgtccgggtcgtagggcggggccaggatgtccaggaaggcggcaggcccttccacggcgtcgatctggtgcaggttgtcccggtgcggtgtgaggatgcagggccgctggcctcggtgtactcggcccgcgaacgcagcacgcccggccgcacggcttctcgctcccggggctgcagcggcggctcgaactgctgctcgggcggcaatggccccgccgttgcccgccgcccgcgtctagcttgtccatgcagctgatgcgcacggtgccgtacagcaccttgacgatgccgtgcatgcccgggtggtcgtgcagcgggatggacgtgccgctcttgagcaggaacacgcccagctgaagccgtccgtctcgtagatgtgcatgtaggtgactggcggcaggttgggcggcagcggctgcagtgtggccttgccggggcgatgttcaagtcctcggcgcggagctgggtcaggaggctcttcagcttgctcaggttctcggggaagcccggctgcatcggcgcc

SEQ ID NO: 284763 - DNA, 1144 bp, Homo sapiens
tgacttgaactaaaaacaattcaaaccactgggtcatgcacagtcaataagttaaaaaactataagaaaaaaaggcataagggcatgagtggaaaataaaccctatttaactaaggggtagggagtgggagcaagaaaaccacttagtattttgtatagaatggggaagagaggaagatattttcattatggctttaggatggaagcgcttcagatagtcccctgccccattcctccaaatcaaagccccagtggcagtgacagtaccaggaaacaatctagcctccccgcccaccccgcccccataaccgtgcccggcggctgctgtccagtcgcccgtgcttcccaaggctgccgaggaagcggctgctgctcattccagtagatccaacgcccaggctagggggtagagacacagcccttgtggtagggtagggcacgtcttcggcccaccgctcctgggcgccagtggcttcaagggaagaccttgggacctggatagggttctccctcgcaccagaagtcatcggcctgtggggtctccaggagccacacctctcgaggcaggtcacaggccgagctggaggcctccttgggcctgaccggctccagcacccgagacagactttcaccatgttgcccaagctggtcccacattcctgggctcaagggatccacctgccttggcctctcgaagtgctggtattacaggcatgagccactatgcccaggcaatccttcaggaagaagaccctggcgaaaattaccttgcatatcaagagttggcggatgaacacgaagcaatcaccttgggaaaaggagtgatgaaagtagaaagcactaaagagattctttatagttcttgatgggtagcctgagttgctcttgccatgtttttgtttgttttttttcactcctcaccgtatctttaaatcctatttttaaaaaaagtaatgaagaggtagccaagatgttcttcaacagatgaaaggataaataaatggtggtacatccagataatggaatattaatcagttataaaaaggaatgagctactaagccatgaaaagacatggaggaaacttaatccatgttactaaattaaagaacccaatctaaaaaggctgcatactgtgtaattcca

SEQ ID NO: 284764 - DNA, 475 bp, Homo sapiens
cggcgcacgaccacctcatgcggggcgacaaagcaacgtgaccttgctctgttgcccagctggagtgcagtggtgcaatcacggctcactgcaaccttgaactcctgggctcgggcaaccctccttcgtctgcctcccaagtagcctggactacagccgctcaaactcctctcgaatttcagcaggggttctcctcctttccacaacctatgcacagaatcaagatgggaagacagttgaggacccaggagaaacaggtttgctagctgctgagaattaaaatcctggactcaaaccctgtaggagaaaaaagaaaacaaagcctggaaagtgtgaagcttcacaaaggctgcagcaggaaaagattcattttcaggaattttagctgtttcatctttgaagactgaactaacagctgaaaattactttctctctgttacattctgtgatgaattacgaacgcaaataatccaaa

SEQ ID NO: 284765 - DNA, 493 bp, Homo sapiens
ttttttttgagacagagtcttgctctgtcgccacccaggctggagtacagtggcttacacctgtaatgccagcactttgggaggccaaggcaggtggatcatttgaggtcaggagttccagacctgcctggccaacatggtgaaaccccatctctactaaaaatacaaaaattagcagcgtgtagtggatacatgcctgtaatcccagctacttgggaggaaggaaggaaagaaggaaggaaggaaagacagacatctaagatatatcaaatgtatctgtgggtacaagagggtaggtgcggcacagagggagtgggaaaatcactataaagggtaaaagtagcaaaatacaatgagaggggccttgtgcagcccatatgtaataatgtgctaagaagtgattagaaattttgaatcactcaactccctatacctgaggcccccctttaaaaagctcacccttcttatatatgaagaaaccaagacactaagt

SEQ ID NO: 284766 - DNA, 989 bp, Homo sapiens
  misc_feature (1)..(3): n is a, c, g, or t
  misc_feature (252)..(252): n is a, c, g, or t
  misc_feature (321)..(321): n is a, c, g, or t
  misc_feature (510)..(510): n is a, c, g, or t
  misc_feature (536)..(536): n is a, c, g, or t
  misc_feature (539)..(539): n is a, c, g, or t
  misc_feature (576)..(576): n is a, c, g, or t
  misc_feature (585)..(585): n is a, c, g, or t
  misc_feature (714)..(714): n is a, c, g, or t
nnnggatattgcaggggatggacccagagggatgcgggggaagagggtctggttctctctagggtggttctggtcccctctgcgtcatgcttgggagtggccagagcctcctggcatagtcaacatgagcagtggtcccggttcctttcttttctcctctccccaagtgctatcctgttcatgcctgtgctcagagcttcctcccttctctcctgggctgtagctgaggcttggaaaggagaaggtccctgnttcctgcagctgatctgatctggagacacccccgtgtagactctggttacagccagatgctcaggttgncgagggactgccgtatgatgacaacataatgagcaaagtgaggagctctgagccattaatacggctgcccggctgaggtaccaaactgattgaacaatacttgaaaggctgaggctggggaggccagtggggctgggtggccctgcaaccacgtggctgcctgttgtcttccttcaactgctggagganttaaacaatgttcttcaaatgaggtnctngtgctcaaggacaggggctgccccaggcaaggagagnagcctgggnagttaccggaaaagcacctactgaatcacccagctacaggagcggagcgagggagcaggtgtgcaccatcaccccaggtgtctcagatgtaggctccatgaatgcaggggcaagaacggaggcccagcncccaggacttgaggtacgtgcggatgcgcttgcgggcccgctcctggaactcagggaactgccggctgcaggactcgatgatggcctggatcttctccttgggctgcttggagatgggcaccatgcggtccaggttctcgtccacaaagagacgcacaaacatctgtggagacacgggccatgggaagggctggccctggccttgcccccatcccaccccacctgtttccggccggtgctcacgttgaaggccttaagacgctcagggtccatgc

SEQ ID NO: 284767 - DNA, 1517 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284768 - DNA, 1523 bp, Homo sapiens
  misc_feature (460)..(460): n is a, c, g, or t
  misc_feature (650)..(650): n is a, c, g, or t
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccaaccacagccaaagcctttgcaaacaaatcgcattaccacaaaagtcgctgttctataatagcccgattttctattctagancattgcggcgcttcccccatgccaatatcgacggacgatgagcgccagtcgagctttcagctgcctacagtcgagctccattgtgccggcgcgtggccccaccctggggagctatggtggccactgtatcaacagctagcagacacccatagccacgatacaaacaaacagacagcactgatgatttganattcagaggatctggttgacctctcgatgggaggtcaggccataccggctggctggtcttccgcagcggctgcgcccgaataggggtgccccctgtgtgcctctagctgctcgaacctgcccgttctccgaggtgtgaccagagttcttcgtaaatgtcgtgcctttattctatatgtttagcctggagctggtgtgtatatcttcagcctcgctaatcgggcatctatgagtttccccgtcttcttgggtattgtctcctgttttgattcactatctgatcgcctcgagatttggacttcattgtcgagaactcatcatcgaaatggaagtatattactccctgatttgaatatttaggatccccaaattggctgaattgattgtgccataaagccctctcagggtcaaaacactgaattttttttccaagattttaaagatactcgccgtggattaaattgtgatattgttgctttgtgagtggatgagataattgccttcaaagaagccagccagaacgcccgccagtgggggcgaggggagaaggcggagtgcggtagtgctttggttataatgctatgttgtttttttatattattggaatgtgccgaatttggcatttgggggaggaataccggattgtgttttaccatcagacattcctctataaatcgcttgttcaattttgtttttaattattgtgccatctgggcttgatggttggcttccatttttggcaaaatgcgccattaatacttggctttactttgtaatttttgggggttttttctagattctttttgtatatgcttctgtttcgagtatgtgttggttgttggggctgaaacggcggttaggggatgagattggc

SEQ ID NO: 284769 - DNA, 1283 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284770 - DNA, 1545 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgcaaaaaaaaaaaataaatataaaccatgt

SEQ ID NO: 284771 - DNA, 2119 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgcaatcgcccctgcttcctatattcgcagtgactcccgcccgcccgccggtggcgcaggacccggctcgggaagggtgcgttccggacccgcagccagcgagcaccagggagcccgggcgccaggtgtgtgtgtggggggggcggggggatggggcgcaggcccgagctactcaggagagagggtctgtcgcttttaaaacgcattaaaggctctctcctggccttatttaacttgcctaagctaggtggagcacggctgagctcaggtaagctagcagctttccagcagaaggtgttctcccgaagaacgcagacctggggaagggttgactttttgggggcccctgctgagaacagttcaagagctccctaactgtagaggctgctggaggggcgaggggcagaaccccgggctgaatcatctcccgctttcccgggactttgctttcactttcctcagtcttgtggacagagtcaagtagattttcaaaagtgctccagaaaggccggaatagtcatgtagtggatgaaaagggcagtcacaaaactgcttaagaccagctgtcttgccagtaattgcagtgctttaagatttaattaaaa

SEQ ID NO: 284772 - DNA, 2485 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgcaatcgcccctgcttcctatattcgcagtgactcccgcccgcccgccggtggcgcaggacccggctcgggaagggtgcgttccggacccgcagccagcgagcaccagggagcccgggcgccagggtctctcgctctgtcatccaggctggagtggagcaatcatggctcactgaggccaaccctacggctgttttcaagtcttccacactctttaaaggaaggccaccccgacatgtcacgagtcaatgaaatgtaagaggcactttctgagaacatgttctcacttataaaaaagcccttggagacacccctcaagagagatagagtaaggatgggggcaccacatcacttacatctcatgagggccccatggagagactgagactgggctgtactggagatgagggccacgcggaaggagtcctgccaactcacgtcctccagggctgagcctgcacactactcccaaccccatgatgtgcaggtgatgtgcatttgctcagaggaaagctggctgcagacttggggatagaaaggacactgtccaccttccacggcagaaattctgaatctctctcagcttcatcttcctcccttgtaggattctgtgattctctaattcctagtgctgctgctatccctcgctgacatgtgcctctgtttgaggaggaaagacagttccaaagtctccagtgctaggtgtgggtgctgaagcagacacctttctatgagagtgtggcagcatggggcgctagaaacaaccagccatctgtgataagtgccttctgcaggctgacaggtgagcttggctgactgaagactttttgtgttacaaagtgctctctggtgcaaagcagaattgcacctgaacatttccaatctatttgtaaagaaaaatttacaaagacagagccattaactttaattttaaaaacatttccaaatttgctgttttagtaattaccaga

SEQ ID NO: 284773 - DNA, 1772 bp, Homo sapiens
  misc_feature (1602)..(1602): n is a, c, g, or t
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactaatcgcccctgcttcctatattcgcagtgactcccgcccgcccgccggtggcgcaggacccggctcgggaagggtgcgttccggacccgcagccagcgagcaccagggagcccgggcgccaggtgtgtgtgtggggggggcggggggattgngttaaggactttggctggtaatgactgactcagtgttgcatttatctttcagccatgaatcgcacggctatagcatggcttgcaccgatctacgtctgcttagtgcttgccatgaggaggtgaaggtctgcgtttgaacggagatgctcaaggggtaggactgtgcttgc

SEQ ID NO: 284774 - DNA, 1466 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaagagcatgctcacttttttatattaatttttacagtatttgtaagaataaagcagcatttgaaatcgc

SEQ ID NO: 284775 - DNA, 1456 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcacagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284776 - DNA, 1415 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284777 - DNA, 728 bp, Homo sapiens
cagggccgcagaccttctttcacaggcggacgccagagccccgtcctgcccggaagaacagggcccccaggagggccggcgccgcttaatcgggtactgctgctaggaggactgcgctgcagctggggcgggcgctggaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284778 - DNA, 1353 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284779 - DNA, 1251 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284780 - DNA, 1137 bp, Homo sapiens
  misc_feature (1103)..(1103): n is a, c, g, or t
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccagccaaaggggnaaaaccttttggtccccccggggggtttttaaaa

SEQ ID NO: 284781 - DNA, 1349 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggaccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284782 - DNA, 1168 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284783 - DNA, 1278 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284784 - DNA, 1253 bp, Homo sapiens
gcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgctttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 284785 - DNA, 932 bp, Homo sapiens
gaactgcttgaagaactgccggaggccggccaggtcccgcgtgagctgctccacgcgctggtgcagcttctcgtcctcagccgacagctccaccaacttctgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgcaatcgcccctgcttcctatattcgcagtgactcccgcccgcccgccggtggcgcaggacccggctcgggaagggtgcgttccggacccgcagccagcgagcaccagggagcccgggcgccaggtgtgtgtgtggggggggcggggggatggggcgcaggcccgagctactcaggagagagggtctgtcgcttttaaaacgcattaaaggctctctcctggccttatttaacttgcctaagctaggtggagcacggctgagctcaggtaagctagcagctttccagcagaaggtgttctcccgaagaacgcagacctggggaagggttgactttttgggggcccctgctgagaacagttcaagagctccctaactgtagaggctgctggaggggcgaggggcagaaccccgggctgaatcatctcccgctttcccgggactttgctttcactttcctcagtcttgtggacagagtcaagtagattttcaaaagtgctccagaaaggccggaatagtcatgtagtggatgaaaagggcagtcacaaaactgcttaagaccagctgtcttgccagtaattgcagtgctttaagatttaattaaaa

SEQ ID NO: 284786 - DNA, 2563 bp, Homo sapiens
  misc_feature (1)..(1): n is a, c, g, or t
  misc_feature (368)..(368): n is a, c, g, or t
natccctgcagtggaagtgaggaggaagaaaggtgaactccttttctcaagcacttctgctctcctctaccagaatcactcagaatgcttcccgggtgtatattcttgatgattttactcattcctcaggttaaagaaaagttcatccttggagtagagggtcaacaactggttcgtcctaaaaagcttcctctgatacagaagcgagatactggacacacccatgatgatgacatactgaaaacgtatgaagaagaattgttgtatgaaataaaactaaatagaaaaaccttagtccttcatcttctaagatccagggagttcctaggctcaaattacagtgaaacattctactccatgaaaggagnagcgttcaccaggcatcctcagatcatggatcattgtttttaccaaggatccatagtacacgaatatgattcagctgccagtatcagtacgtgtaatggtctaaggggattcttcagaataaacgaccaaagatacctcattgaaccagtgaaatactcagatgagggagaacatttggtgttcaaatataacctgagggtgccgtatggtgccaattattcctgtacagagcttaattttaccagaaaaactgttccaggggataatgaatctgaagaagactccaaaataaaaggcatccatgatgaaaagtatgttgaattgttcattgttgctgatgatactgtgtatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggagtgtactaatccttgctgtgatgcacacacatgtgtactgaagccaggatttacttgtgcagaaggagaatgctgtgaatcttgtcagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatgaggcaatagagagtcatgatatctgctacaagatgaatacaaaaggaaataaatttggatactgcaaaaacaaggaaaacagatttcttccctgtgaggagaaagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaataaacctgcaagtaaagattcaagaggaatcgcagatcccaatcaaagtgccaagtgagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcag

SEQ ID NO: 284787 - DNA, 1930 bp, Homo sapiens
agcggggtttgccctcgtagctatttcctggagggaaggggtagctacagtttcctgtccctcttcagcacttctccagctccatatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggagtgtactaatccttgctgtgatgcacacacatgtgtactgaagccaggatttacttgtgcagaaggagaatgctgtgaatcttgtcagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatgaggcaatagagagtcatgatatctgctacaagatgaatacaaaaggaaataaatttggatactgcaaaaacaaggaaaacagatttcttccctgtgaggagaaagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaataaacctgcaagtaaagattcaagaggaatcgcagatcccaatcaaagtgccaagtgagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcag

SEQ ID NO: 284788 - DNA, 384 bp, Homo sapiens
actgcttaattagcaatggctagggagatctataaaagcatgaataaatgtaggactacagaacacagaaaggttattctaattagtagatataaatgagtaatggaaatacatggttcacagatttcataggaaacaatctatttttaaccatctgtttctatttagagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcaga

SEQ ID NO: 284789 - DNA, 1005 bp, Homo sapiens
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaattta

SEQ ID NO: 284790 - DNA, 603 bp, Homo sapiens
acaggggctatttgtttggatatcctgaaagatcaatgttttaggccggttgctggccggatgtggtggctgatgcctgtaatcccagcagtttgggaggccgaggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaattta

SEQ ID NO: 284791 - DNA, 955 bp, Homo sapiens
  misc_feature (770)..(770): n is a, c, g, or t
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcgtatagtggcttgtttcaaatctgggtgtnagatggacagattggtctgagaatagggtataagcgggtgatataggtcctttgaagggccaatcggtttagatcggaaatttaacggatctcaagtttttgcctggaggaaaacgtgtatactgtttaagggggcgcagataatcggaggacgccgcactgtgcgtctaattattatatagggt

SEQ ID NO: 284792 - DNA, 477 bp, Homo sapiens
gtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaagccggttaacactaaaatatggcatcctaatattagacttgaacaaacaaaacacccaacaaaaaagaacaagagaataatttaaaagttgaatcattacttgactaacagacttcggtccaccatgtccttttcacagccctcttctggaacagtcaccttgttaattttattttggaaaattattttcccactctgccctt

SEQ ID NO: 284793 - DNA, 5196 bp, Homo sapiens
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatgggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatataccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaaaaaataaaatgatgaaacaaaaaact

SEQ ID NO: 284794 - DNA, 5101 bp, Homo sapiens
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatgggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatataccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaa

SEQ ID NO: 284795 - DNA, 4746 bp, Homo sapiens
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatgggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatataccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttacaagaaaaaataaaatttgagtttttagatttattgtt

SEQ ID NO: 284796 - DNA, 5807 bp, Homo sapiens
taggtttgagaatataagtggagagcccatttgctggcaggcacttatgaatgttaatgtgagtcccactggatggttttctgaatcatttaaggttatcatggctctgagaatggactgtcataaggttaagagactcagtaatgctatagataggaaagtacttggagtagtttaaagtgcaaaataagtcaatgtagataaatttaaagtagaaatctggttttttgaagtaggtagttgccgttttaataaactaagcagaaaaacaaattgaagaaggccttttcttttgaggcatttagtcctctggaatttttcatggaaaggagaatctgttaggtagctagagctttcaccattctggtggatagtgtactatttcagtcagttaaactaaacatttaaagttgttatggttagttcaagtgagagtttatggcctaaatggcttttaatgaccctgaattttctgtttaagcagaacccatgtatcgtgggggtatagtgcagaatataatatcttagtgttcatctgtggatgattagatttatcgctttggacctgatatacatggaattggcaaacataaaatagcttttatactatttttccctaataacattcctagaaagtcaagaagccattgtattgttgttcatagtggtgttatttcgtttaaaacaatgaagttagaatttattagtttgttttaaatattcttaaaactggataattaagtcctagaaaagccgagacttattttactagagcagataatcaggcttatgaacagagggggtttcaagatttttataggtaatactttaggcgtttttcttgctgacataactaacatttatttcctgtttatcttaagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatgggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatataccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaaaaaataaaatgatgaaacaaaaaact

SEQ ID NO: 284797 - DNA, 5048 bp, Homo sapiens
gtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatgggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatataccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaaaaaataaaatgatgaaacaaaaaact

SEQ ID NO: 284798 - DNA, 2549 bp, Homo sapiens
  misc_feature (2377)..(2380): n is a, c, g, or t
  misc_feature (2403)..(2403): n is a, c, g, or t
  misc_feature (2444)..(2444): n is a, c, g, or t
  misc_feature (2456)..(2456): n is a, c, g, or t
  misc_feature (2492)..(2492): n is a, c, g, or t
  misc_feature (2516)..(2516): n is a, c, g, or t
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatataannnntaaaaaaaaaaactcgtcgaaanaaatatacctttaagcattttaataaaatgttatgcttctnagcatattcctnatatatactagtgaagaggaacatgttctccttgcntgagagctctattcattatatgtntgtgctcaattgtatacagcatcactgtgatgt

SEQ ID NO: 284799 - DNA, 5043 bp, Homo sapiens
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatgggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatataccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaaaaaataaaatgatgaaacaaaaaact

SEQ ID NO: 284800 - DNA, 4990 bp, Homo sapiens
gtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgatagggtaagtacataagggcatgcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatgggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatataccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaaaaaataaaatgatgaaacaaaaaact

SEQ ID NO: 284801 - DNA, 4787 bp, Homo sapiens
ggctgcagtgagcgatagtcatgccactgcactccagccttggtgatagagcaagaccctgtctcaaaaaaaaaaaaaaaaaaaaaaaaaggaaaataagagaaaatctagttttggtaaacatattttctgttttcaaagtcagtgatttttttatttttactaattactgtcattgattttagaagctttccatgcactgcaaatgtaaatcaacttacagaaaagaaacaaggtgttaattcccagtataaagagtgaatgattcagtattgtttaaatgtttccttgagatttaatttcctgtccccttttcttctctacagaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatgggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatataccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaaaaaataaaatgatgaaacaaaaaact

SEQ ID NO: 284802 - DNA, 4356 bp, Homo sapiens
tatcacaggcgtcctagctggtatatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatgggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatataccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaaaaaataaaatgatgaaacaaaaaact

SEQ ID NO: 284803 - DNA, 2021 bp, Homo sapiens
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattcta

SEQ ID NO: 284804 - DNA, 1054 bp, Homo sapiens
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaactatctaaagagtgacagccccgcgatacacccgggagcattgtgtgactcacgaacaacgtcccgtgtctatgggggccctggtgtaacattgatcggttgt

SEQ ID NO: 284805 - DNA, 876 bp, Homo sapiens
atgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaattta

SEQ ID NO: 284806 - DNA, 610 bp, Homo sapiens
aattgtgagtcgaagcttcaggttaagtggtcttttctcgagtgacataggttgtctataatgcaaagtgaatcacattttaaatgtagatttgttttatttggaaaagtaggattgtaggcgataagagctgaaatatatcaaatattataactgtaatgtcatgtcaatcaatttttccccccatatagtacaaacaaaatcccgaaatgttcaaacagacagctcgactttgggcacatgtgtatgctggagcaccagtttctagtccagaatacaccaaaaaaatagaaaacctatgtgctatgggctttgatagggtaagtacataagggcatgttgattttgatatattgattgattttaaattattgcaaattcttggctgacaaaagtggtttagaaaataagagaaattcgcagcctgggcaacatggcgaaacccatctctacaaaaattagctggacatggtagtgagtgcctgtaattccagctactctgaaggctgaggtgagagaatcccttgggcccaggaggtcgaggctgcagtgagcgatagtcatgccactgcactccagccttggtgatagagcaagaccctgtctcaaa

SEQ ID NO: 284807 - DNA, 435 bp, Homo sapiens
atgatgtaatagatatagggacctttctttttttagtttgaagatttcattttcttgtagttctacttaaactgttttatttctgttactgaaaaactcaagtgtgctttatattctaggtccggtttatcactaaaatatggcatcctaatattagttccgtcacaggggctatttgtttggatatcctgaaagatcaatggtaagagattttgaattcaccttctctccttctcatatgaataccaagactgtaagagtgttaaatgtgtaattgcctcaaaacatatattatactttatcttgtttgggcagtaactttaaaagtctcttaagtgcataactgaaaatgcattataattgagatcacaatccatatttaaatagaaacttgttagataatgttagatgctagctttacactttgaaagcctt

SEQ ID NO: 284808 - DNA, 2586 bp, Homo sapiens
ttttttcctgagacagagtcttgctctgttgcccaggctggagtgcaatggcacaatctcaactcactgcaacctccaccccctgagttcgagcaattctcctgccttggctcccgagtagctgggattacaggcgcctcaccatgcctggctaatttttgtatttttagtagagacggagtttcagcatttgcaggtgattttgaactgctgacctcaggtgatccacctgcctcagcctcccaaaatgctgggattacaggcatgagccactgcgcccagccgagagttttaaagaaggtgaaagctcttcccttttcctaacctagcctggccttgattccgctgatctaccttctgagatatcatccttcttcagggagataaggaaaaaaagccacagggtcccggagagccaggggaatggtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccaggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagacagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaa

SEQ ID NO: 284809 - DNA, 2713 bp, Homo sapiens
cgccgagcatcctgggaggtgtggtccgggcgctgtgccgaggattcggggtagtgtagtcctggcgccccgctggaggagctccccagctggtggctggagcgaccccttgttctttggtggcgctgatctaccttctgagatatcatccttcttcagggagataaggaaaaaaagccacagggtcccggagagccaggggaatgcttcaaaagttctgctgcctgagagtaacgtcacagtaatggaacgggaagattctggaatctgtgtccccacctagacaacgattatactggcaggatctatcaggtgtacctattttggaactctggagtctagttgaaggcctccagttcccagggggaaggaagcatggaggtgtgtcctccatttggaagtagtgctaagaaaattaaaagaataaaactgggcaggggcatgagaataggatgcaaagatgaatttttggactgagtggccaagaagctccatggtgagcactcacagtctaaggctggaagtttaatgaactgttttctacatttcacaggtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccaggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagacagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaa

SEQ ID NO: 284810 - DNA, 2248 bp, Homo sapiens
ccacgcgtcgccacgcgtcgccacgcgtcccgctggaggagctccccagctggtggctggagcgaccccttgttctttggtggcgctggtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccaggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagacagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaa

SEQ ID NO: 284811 - DNA, 1420 bp, Homo sapiens
ccacgcgtcgccacgcgtcgccacgcgtcccgctggaggagctccccagctggtggctggagcgaccccttgttctttggtggcgctggtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccaggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagacagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaa

SEQ ID NO: 284812 - DNA, 1126 bp, Homo sapiens
tacagtcatgagcactggtgcccagccttaatttggtttttaatctagagacagagtcactatagtctgtcacccaggctggagtgaagtggttattcacaggcaggatcatagcacactatagcctcaaactcctggactgaagcaatcctcctgcctcagcctcctgagtagctggaactacaggtgtgagcccccatgctcagctttgtttcctactttaaacacttaccttgatgactttctggttcacaatctcagagttttcatcccatctctgatctttcctgttctcaatattctatgactaaaacttttaatggtgttggctttttatttttattttacttttttgagacagggtctcactctgtccctcaggctagagtattgtgatgcaactgtggctcactgtggccccaagctcctgggcttgaacaatcctcctgcctcagcctcccaagtgtagctgggactacaggcacacgccaccatgcccagctaatttttgttttttttaatgtagagataagagtctcactatgttgcccaggttgatctcaaactcctggtctcaagagatcctcccacctcagcctcccagagtcagaacccagatcctggaactcttcttttcttcttctataccactgcttccttgtcctcacgagcctttctctgcgagtccaaaattcagccacatttcctaagaggcacctgtacttgtctatttcaatgcagccagaagctgacaacggcccaggaaccaggactgctttcaggaggcgctcagaagggcagcaaagtaccctctcaacattagtaaaatgaaacaaaagtgtcagccttggcttcgcacacacttacccgttcatgacattgggaacagagaaggctatggcagagtggagcagcagcgtccatgccagacagacactccaaacaagggactcaagatatgtaactccgttatacacaaggaggacgaggaagcgctcgtttcacagggctggacatccttaggtcacagtcatcatacctctgtactgctgctgagctcatagtcaaaggccatccatgcctttagagatggacacatgacccatcctaggccaagcaggacctc

SEQ ID NO: 284813 - DNA, 836 bp, Homo sapiens
tacagtcatgagcactggtgcccagccttaatttggtttttaatctagagacagagtcactatagtctgtcacccaggctggagtgaagtggttattcacaggcaggatcatagcacactatagcctcaaactcctggactgaagcaatcctcctgcctcagcctcctgagtagctggaactacaggtgtgagcccccatgctcagctttgtttcctactttaaacacttaccttgatgactttctggttcacaatctcagagttttcatcccatctctgatctttcctgttctcaatattctatgactaaaacttttaatggtgttggctttttatttttattttacttttttgagacagggtctcactctgtccctcaggctagagtattgtgatgcaactgtggctcactgtggccccaagctcctgggcttgaacaatcctcctgcctcagcctcccaagtgtagctgggactacaggcacacgccaccatgcccagctaatttttgttttttttaatgtagagataagagtctcactatgttgcccaggttgatctcaaactcctggtctcaagagatcctcccacctcagcctcccagagtcagaacccagatcctggaactcttcttttcttcttctataccactgcttccttgataagagatcaagatatatacaaattagtctttgaaagatctttcaccttgttcaaagttaagatcctgtgaacaccagaattgttccatggcctcttcactattgattgcaacagtatcatttacctgaagttacacagtgaccacaaaaaccatgtccaggacaccaaatttc

SEQ ID NO: 284814 - DNA, 390 bp, Homo sapiens
ccaaaatctgaaataaaatttgaaattatatattttttaaaaggcaaatactttaacattccacttatacgaggcacctaaagtagtcaaaatcaaagagacggaaagtggaatggtggttaccagagggaggtggaagggcagaaggagatgaatggggagttactgtttaacaagcagttttacaagataaaaagtattatggagatggacggtggtgatggttgcacaacattattaatgtatccgataccactgaactgtgcatttaaatggttaagatggtaaattttatgttacgtgcatttcaccatgcgaattttatggtatgtaaattatacctcaagctgttaaaaaaaaacctgtgagaaattcaaactgcccatccac

SEQ ID NO: 284815 - DNA, 738 bp, Homo sapiens
cttttttttcatcttatatataaagggttcttcattagctaataaagtcccagaaaggctggctctcctgtaagggcagagccatgttctgcctagtttcaaagcctcttcaagtggagagcttgacaccaggctgggcggggcaggcctggctgaggtgccctggtgtatatgctccccctggcttctggcctctggttcccacagtgctgaggcatggggtggccctgggatgactaggtggtccttctcgaggcacctggctcaccacttcctcttcctaatagtgagatggcctttgtcccaacagaacctgaatggtgtgccctcgatcaccaaccccatcaaaactgcaaaccaacaccagggcaagaagcaacacccatcccaggtaatagaacggccccttctagctctgtttcctacatgaaacgctgtgaactgcttcccaagggcactggtcttgaagtcgtaagggaatcaggctagtgagctgtcaccaggcactcattactctcatacatgtctggcctgtgtgcgccatggaggtgagacatcaagctcacttgactgtagcaagacagtccactgcctgagccccagtgtcttcaacgataaaagctggggtttggtgtagatcagaggtcctcaaactagtcttcaaaggtgcttcagggacactgcaaatattttatttgagtatcctaagattgtaaggcacctgcttttctgaactaa

SEQ ID NO: 284816 - DNA, 2894 bp, Homo sapiens
agttttgtcctttgataaaaaggaatgtcttggggacttttcttttctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttctgctgacacctagaatgaagttactctattactaatcaagccgagaggaggcccactatgcccccgtttatcatcctttcccagttcctttttgctggtcacaaaacgatgctcatcaatcccacctaaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctctacccgttcttcggagtcctccggtccaatgaggtggcggcggagtacttcaagaacaccacgctgctgctggtgggggtcatctgcgtggcggctgccgtggagaagtggaacctgcataagcgcattgctctgcgcatggtcttgatggccggggccaagccgggcatgctgctgctctgcttcatgtgctgtaccacgttgctgtccatgtggctgtccaacacctccaccaccgccatggtgatgcccatcgtggaggccgtgctgcaggagctggtcagtgctgaggacgagcagctcgtggcgggcaactccaacaccgaagaggccgaacccatcagtctggatgtaaagaacagccaaccttctctggaactcatctttgtcaatgaagacaggtccaacgcagacctcaccactctgatgcacaacgagaacctgaatggtgtgccctcgatcaccaaccccatcaaaactgcaaaccaacaccagggcaagaagcaacacccatcccaggaaaagccacaagtcctgacccccagccccaggaagcagaagctgaacagaaagtacaggtcccaccatgaccagatgatctgcaagtgcctctccctgagcatatcctactccgctaccattggcggcctgaccaccatcatcggcacctccaccagcctcatcttcctggaacacttcaacaaccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagaggatccaagaagaatatgaaaaactgggagacattagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctgtctgaaacgctgcacattaaccccctctacaccctgatcccagtcaccatgtgcatctcctttgcagtgatgctgcctgtgggcaatccccctaatgccatcgtcttcagctatgggcactgccagatcaaagatatggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacag

SEQ ID NO: 284817 - DNA, 465 bp, Homo sapiens
ccgggagcccgtaaccctgtggcccgactaccagagctattctttgcttcactaaggacgtttttctggctaaggccgctagtccatgaagtgtgattcattcgttcaagaagtattgctttaataccttacgctggtgccaagcattgggagtacagagctgaatggcaccctgcaggacaaatgcctgccctttccagccacagctgtctagaacagccccagcaggttggtaggaggcccactgtggagccgcagggatgtgtgttccgtggacgctctgccccaaccctccctgccttccaggctgctgctctgcttcatgtgctgtaccacgttgctgtccatgtggctgtccaacacctccaccaccgccatggtgatgcccatcgtggaggccgtgctgcaggagctggtcagtagggttaagaccccacgtaagatcctgctaagtcactttaaact

SEQ ID NO: 284818 - DNA, 430 bp, Homo sapiens
tcccagcactttgggaggccacagcaggaggaccacttgaggccaggagttcaagaccagcctggccaacatggtgaaaccccgcctgtactaaaaatacaaaaattagctgggagtggtgatgggcaccggtaatccccactacttgggaggctgaggctggagaatcacttgaacctgggaggcagaggttgcagtgagcccagatcgtgccactgcacttcagcctgggcaacagagcgagacccccatctcaaaaaataaaaataaataaaaataaaaagaacacatttacaggggaaagcagagtttacctgcacacagttactcgaacttatttcacctcccccaaatctggttatacatcttttcatgagaagtataaaaggccaattaaacattggacttcagctgggtacaatgatgtgca

SEQ ID NO: 284819 - DNA, 2814 bp, Homo sapiens
agttttgtcctttgataaaaaggaatgtcttggggacttttcttttctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttctgctgacacctagaatgaagttactctattactaatcaagccgagaggaggcccactatgcccccgtttatcatcctttcccagttcctttttgctggtcacaaaacgatgctcatcaatcccacctaaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctctacccgttcttcggagtcctccggtccaatgaggtggcggcggagtacttcaagaacaccacgctgctgctggtgggggtcatctgcgtggcggctgccgtggagaagtggaacctgcataagcgcattgctctgcgcatggtcttgatggccggggccaagccgggcatgctgctgctctgcttcatgtgctgtaccacgttgctgtccatgtggctgtccaacacctccaccaccgccatggtgatgcccatcgtggaggccgtgctgcaggagctggtcagtgctgaggacgagcagctcgtggcgggcaactccaacaccgaagaggccgaacccatcagtctggatgtaaagaacagccaaccttctctggaactcatctttgtcaatgaagacaggtccaacgcagacctcaccactctgatgcacaacgagaacctgaatggtgtgccctcgatcaccaaccccatcaaaactgcaaaccaacaccagggcaagaagcaacacccatcccaggaaaagccacaagtcctgacccccagccccaggaagcagaagctgaacagaaagtacaggtcccaccatgaccagatgatctgcaagtgcctctccctgagcatatcctactccgctaccattggcggcctgaccaccatcatcggcacctccaccagcctcatcttcctggaacacttcaacaaccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagaggatccaagaagaatatgaaaaactgggagacattagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaacctaaa

SEQ ID NO: 284820 - DNA, 2952 bp, Homo sapiens
agttttgtcctttgataaaaaggaatgtcttggggacttttcttttctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttctgctgacacctagaatgaagttactctattactaatcaagccgagaggaggcccactatgcccccgtttatcatcctttcccagttcctttttgctggtcacaaaacgatgctcatcaatcccacctaaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctctacccgttcttcggagtcctccggtccaatgaggtggcggcggagtacttcaagaacaccacgctgctgctggtgggggtcatctgcgtggcggctgccgtggagaagtggaacctgcataagcgcattgctctgcgcatggtcttgatggccggggccaagccgggcatgctgctgctctgcttcatgtgctgtaccacgttgctgtccatgtggctgtccaacacctccaccaccgccatggtgatgcccatcgtggaggccgtgctgcaggagctggtcagtgctgaggacgagcagctcgtggcgggcaactccaacaccgaagaggccgaacccatcagtctggatgtaaagaacagccaaccttctctggaactcatctttgtcaatgaagacaggtccaacgcagacctcaccactctgatgcacaacgagaacctgaatggtgtgccctcgatcaccaaccccatcaaaactgcaaaccaacaccagggcaagaagcaacacccatcccaggaaaagccacaagtcctgacccccagccccaggaagcagaagctgaacagaaagtacaggtcccaccatgaccagatgatctgcaagtgcctctccctgagcatatcctactccgctaccattggcggcctgaccaccatcatcggcacctccaccagcctcatcttcctggaacacttcaacaaccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagaggatccaagaagaatatgaaaaactgggagacattagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctgtctgaaacgctgcacattaaccccctctacaccctgatcccagtcaccatgtgcatctcctttgcagtgatgctgcctgtgggcaatccccctaatgccatcgtcttcagctatgggcactgccagatcaaagatatggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaacctaaa

SEQ ID NO: 284821 - DNA, 2025 bp, Homo sapiens
agttttgtcctttgataaaaaggaatgtcttggggacttttcttttctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttctgctgacacctagaatgaagttactctattactaatcaagccgagaggaggcccactatgcccccgtttatcatcctttcccagttcctttttgctggtcacaaaacgatgctcatcaatcccacctaaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctctacccgttcttcggagtcctccggtccaatgaggtggcggcggagtacttcaagaacaccacgctgctgctggtgggggtcatctgcgtggcggctgccgtggagaagtggaacctgcataagcgcattgctctgcgcatggtcttgatggccggggccaagccgggcatgctgctgctctgcttcatgtgctgtaccacgttgctgtccatgtggctgtccaacacctccaccaccgccatggtgatgcccatcgtggaggccgtgctgcaggagctggtcagtgctgaggacgagcagctcgtggcgggcaactccaacaccgaagaggccgaacccatcagtctggatgtaaagaacagccaaccttctctggaactcatctttgtcaatgaagacaggtccaacgcagacctcaccactctgatgcacaacgagaacctgaatggtgtgccctcgatcaccaaccccatcaaaactgcaaaccaacaccagggcaagaagcaacacccatcccaggaaaagccacaagtcctgacccccagccccaggaagcagaagctgaacagaaagtacaggtcccaccatgaccagatgatctgcaagtgcctctccctgagcatatcctactccgctaccattggcggcctgaccaccatcatcggcacctccaccagcctcatcttcctggaacacttcaacaaccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagaggatccaagaagaatatgaaaaactgggagacattaggtaaaaatcagccattcctcttccctccttctccagcagaaacacagcaggtaaagtgagcacaggagcagccctgttcctgacaatccctgacactgggagaattttccacaactctgaatcaggcctttagaagatgctatttagtgccaaagccaagctggccca

SEQ ID NO: 284822 - DNA, 1630 bp, Homo sapiens
agttttgtcctttgataaaaaggaatgtcttggggacttttcttttctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttctgctgacacctagaatgaagttactctattactaatcaagccgagaggaggcccactatgcccccgtttatcatcctttcccagttcctttttgctggtcacaaaacgatgctcatcaatcccacctaaagcaggaggccaggagcccagcctcttgtagaaacagcgagggtataactgccctcccgttctgcccccaagacgaaggaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctctacccgttcttcggagtcctccggtccaatgaggtggcggcggagtacttcaagaacaccacgctgctgctggtgggggtcatctgcgtggcggctgccgtggagaagtggaacctgcataagcgcattgctctgcgcatggtcttgatggccggggccaagccgggcatgctgctgctctgcttcatgtgctgtaccacgttgctgtccatgtggctgtccaacacctccaccaccgccatggtgatgcccatcgtggaggccgtgctgcaggagctggtcagtgctgaggacgagcagctcgtggcgggcaactccaacaccgaagaggccgaacccatcagtctggatgtaaagaacagccaaccttctctggaactcatctttgtcaatgaagacaggtccaacgcagacctcaccactctgatgcacaacgagaacctgaatggtgtgccctcgatcaccaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaacctaaa

SEQ ID NO: 284823 - DNA, 2342 bp, Homo sapiens
tcagacgcgccaccacagtggtgcggttatcactcccagggagatgggagactctgtgctatatttagggtataaggcagtatcaaagacagacttggagagagagcgtccaagaaatcactaaccaaccctcagccacttccatcagcttttccacagggacccagcttcctatttagtgctatttctccttttatggcaattggcacatacaactttgcataaaacaatccaggtagacactgtcttatttaaagctttaagttataaaaggaatacatgttcattgtagaacatttcaaaaatacaagacagtataagaaaaaaatcaaaattgactggattcttagcaccccatgttaacaaatgttaacacttctttccatgcttttttgtgcaaaactcttatgtatttttggtaaaattcagtccacactgaaactgttgtataccttgcctttctcaactcaactttgtactctcagtacagtatgttccacatccttaactctgctgtggaaatgggattatcaatggatgcatctcattttaacacagagttgtatcaaaatgtattcagtgtcatgaaataccattggatatagaggatgcttccattttttaataggtaattaatgtctcagtatgcatttctggttagatgatgggaatgaccaactattttttttttttttttttttttttttttgggatggagtctcacccttttgcccagtctggagtgcagtggcacaatcttggctcgctgaaacctccacctcctgggttcaagcgattctcctgcctcagcctcccgagtaactgggactacaggcacgtgacaccacgcccagctaattttttgcatttttagtagagatggggtttcactgtgttagccaggatggtctccatctcctgacctcatgatccgcccacctcggcctcccaaagtgctgggattacgggcgtgggccaccacacccagccagggaatgaccaactttaaggcttctaatgtgtatcatcaaatggcctcaaaaaggttgtagcaattcctcctcccaccagcacagtgtttggggctgcctatttcactgcactctccttgtaggctgtatttgaaattattttacaaatgtacagtgctgtgttctcttgccctttctactgaagtttctccaggaacatggttaatgtcatgttttctggggccactcagtcttctcctcatctcactgtcagccattcatagtggttaggcagtgagtgtgttttatgtctagggtattgaaactctaaatacagaagcttccagaagcaaagtgaaaaagctaggagaaatttctcagttcctgagtgggtctttctgttttattttatagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaacctaaa

SEQ ID NO: 284824 - DNA, 2022 bp, Homo sapiens
gacattctaaacatttgtgaactctgcacttcactctcagctctacaacgaaatgttcttaattccaactaaatggttagagagcctgtccagtttatacaaagtctgaggtgaagagtatttaatgtcgttttattgctctcaaagcatacagagcacttccaattactccaagaaataggaaataaaaaatatgactctaagtagaatttgcattaggtttaactttataggcatgggtgatttatacttagtagcctgaataaaatatgctcatatgcctcaaaataacaagtcagtctactccaaatttgatcagtttcaaacacataagggaagataatataatgttttgctattagtccatgtaacccaatgctcccattggtcaagaaatgttctctgacttttctttttactcagactgttgtcaaaccaatgataactatatacttcttaactccagtattgctaacataaaactaacactgtgtgttccatatacgcagatgtttgtgtgtttgtttggctagagacaaagcttctctggagtaaaaatgttagttatacatctagacacatagtggaataaaagttttagtttatacatctagacacatataccacattacactgattattttacttacgtaaaagacaagtaggtagaaatgaccccacacgaatacacttgcacaagtccctgagacatcacttcacaccaatacaccagagacagacccagatggatatccccagtaggggctgcctatttcactgcactctccttgtaggctgtatttgaaattattttacaaatgtacagtgctgtgttctcttgccctttctactgaagtttctccaggaacatggttaatgtcatgttttctggggccactcagtcttctcctcatctcactgtcagccattcatagtggttaggcagtgagtgtgttttatgtctagggtattgaaactctaaatacagaagcttccagaagcaaagtgaaaaagctaggagaaatttctcagttcctgagtgggtctttctgttttattttatagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaacctaaa

SEQ ID NO: 284825 - DNA, 2021 bp, Homo sapiens
gacattctaaacatttgtgaactctgcacttcactctcagctctacaacgaaatgttcttaattccaactaaatggttagagagcctgtccagtttatacaaagtctgaggtgaagagtatttaatgtcgttttattgctctcaaagcatacagagcacttccaattactccaagaaataggaaataaaaaatatgactctaagtagaatttgcattaggtttaactttataggcatgggtgatttatacttagtagcctgaataaaatatgctcatatgcctcaaaataacaagtcagtctactccaaatttgatcagtttcaaacacataagggaagataatataatgttttgctattagtccatgtaacccaatgctcccattggtcaagaaatgttctctgacttttctttttactcagactgttgtcaaaccaatgataactatatacttcttaactccagtattgctaacataaaactaacactgtgtgttccatatacgcagatgtttgtgtgtttgtttggctagagacaaagcttctctggagtaaaaatgttagttatacatctagacacatagtggaataaaagttttagtttatacatctagacacatataccacattacactgattattttacttacgtaaaagacaagtaggtagaaatgaccccacacgaatacacttgcacaagtccctgagacatcacttcacaccaatacaccagagacagacccagatggatatccccagtaggctaggggagaaggttgatgagaggccggataacttggcagataaaagccatatgaataggtgggggatagagggatagagcatgtgaaagaggagaaaagtgaccacagcaggcaagcggtttagtatttacctaatatttgatctctgggcctcagaagtgtgttttctttaatcatttgctcattctcccttctcagttttaaagagacctgctctctgagcaagaagaagaagaccaaaagggaacagttgtcagagaagaggatccaagaagaatatgaaaaactgggagacattagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaacctaaa

SEQ ID NO: 284826 - DNA, 2979 bp, Homo sapiens
  misc_feature (502)..(502): n is a, c, g, or t
  misc_feature (504)..(504): n is a, c, g, or t
  misc_feature (514)..(514): n is a, c, g, or t
  misc_feature (532)..(532): n is a, c, g, or t
agttttgtcctttgataaaaaggaatgtcttggggacttttcttttctgctttgcaggcccaggctcaaggcaaattataagtagggaaccaatttgagggaaagacatgtgaacagagttaaggtaccacgtcctgggagcgaccagcagccccacctgaagtccgcatgcaactctgacaagctcaggtgcttgttttaaggaaaggggctactagagtcttaccaacagcgagcccaggtgggagatgaaacaggtactccccaaaataggtcatccgagggaggaaaactgatggagagcacaatgtgctctgagcgtttttaatgtttttaagcttttaaatgatttcttcaaggccgagcagcagcagcaaaggtgtggcttaaaggattaagggggtttcgtggcgatgatcgacgccgtaaggacagtgcacaggcatgtacctggtcgtaagtgtaactgtgaagtccgaacgcgctgcacgcacgggcaggngncgctccgacntaatgtggcctccctcgngttgtgtaagtcgagttcgcgtgtgtacgccgagagtatgccgttttcttgacgtgggatctacgaagagagcgaaagtggctttccagtgcgagaatgccgccagcacctgatagaggccagggaaggggccgatggggagagctccgcaggacactttcgtatggtaggagatacgacgcgagggagtaatacacgtggtctcgctaccccggtttcttgtccgcccccaataggaacgaaagggaaggactctcggaagccaagaaaggtttaagaagtctttctggatagagagcagtgcccaggcaggaagcctttcgccggcagagcggggtccaaggacgagctggagaggacagaggcgcgatgggcctgctgcagggcctgctccgagtccggaagctgctgctggtcgtctgcgtcccgctcctgctgctgcctctgcccgtcctccaccccagcagcgaggcctcgtgtgcttacgtgctgatcgtgactgctgtgtactgggtgtcggaggcagtgcctctgggagctgcagccctggtgccggccttcctctacccgttcttcggagtcctccggtccaatgaggtggcggcggagtacttcaagaacaccacgctgctgctggtgggggtcatctgcgtggcggctgccgtggagaagtggaacctgcataagcgcattgctctgcgcatggtcttgatggccggggccaagccgggcatgctgctgctctgcttcatgtgctgtaccacgttgctgtccatgtggctgtccaacacctccaccaccgccatggtgatgcccatcgtggaggccgtgctgcaggagctggtcagtgctgaggacgagcagctcgtggcgggcaactccaacaccgaagaggccgaacccatcagtctggatgtaaagaacagccaaccttctctggaactcatctttgtcaatgaagacaggtccaacgcagacctcaccactctgatgcacaacgagaacctgaatggtgtgccctcgatcaccaaccccatcaaaactgcaaaccaacaccagggcaagaagcaacacccatcccaggaaaagccacaagtcctgacccccagccccaggaagcagaagctgaacagaaagtacaggtcccaccatgaccagatgatctgcaagtgcctctccctgagcatatcctactccgctaccattggcggcctgaccaccatcatcggcacctccaccagcctcatcttcctggaacacttcaacaaccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagaggatccaagaagaatatgaaaaactgggagacattagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaacctaaa

SEQ ID NO: 284827 - DNA, 1755 bp, Homo sapiens
cttttttttcatcttatatataaagggttcttcattagctaataaagtcccagaaaggctggctctcctgtaagggcagagccatgttctgcctagtttcaaagcctcttcaagtggagagcttgacaccaggctgggcggggcaggcctggctgaggtgccctggtgtatatgctccccctggcttctggcctctggttcccacagtgctgaggcatggggtggccctgggatgactaggtggtccttctcgaggcacctggctcaccacttcctcttcctaatagtgagatggcctttgtcccaacagaacctgaatggtgtgccctcgatcaccaaccccatcaaaactgcaaaccaacaccagggcaagaagcaacacccatcccaggaaaagccacaagtcctgacccccagccccaggaagcagaagctgaacagaaagtacaggtcccaccatgaccagatgatctgcaagtgcctctccctgagcatatcctactccgctaccattggcggcctgaccaccatcatcggcacctccaccagcctcatcttcctggaacacttcaacaaccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagaggatccaagaagaatatgaaaaactgggagacattagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaacctaaa

SEQ ID NO: 284828 - DNA, 1585 bp, Homo sapiens
tgtgtcccccaatcaaaacttacattcctttggtgattttagaaacaaagtataccaagctgttccattttctgttgccttgaaaaccagatgaataaacttagcagaatctttaagggcaaacacgtcctgagtcattctcttgagtgcaaagtatatacactttaatgatattaattttagttgttttgattcctttttttagctagtttcatgattcttgtctgggctctgtacaattgcaactgtcaactaaatgagtcctaggcaacgttttaccatatcgttatcattatctccccacttagcccagctgtatgttttagggagcatttggcatactaccccaaaataccatatggaaaccctccctttctaattgctgacctggttctttaccctccagccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagaggatccaagaagaatatgaaaaactgggagacattagctacccagaaatggtgactggatttttcttcatcctgatgaccgtactgtggtttacccgggagcctggctttgtccctggctgggattctttctttgaaaagaaaggctaccgtactgatgccacagtctctgtcttccttggcttcctcctcttcctcattccagcgaagaagccctgctttgggaaaaagaatgatggagagaaccaggagcactcactggggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaagccataggctcacagaaaaagaaaaagaaaataaaaattaaattaaaaaaaaagaagacaaagaaaacctaaa

SEQ ID NO: 284829 - DNA, 1232 bp, Homo sapiens
gacattctaaacatttgtgaactctgcacttcactctcagctctacaacgaaatgttcttaattccaactaaatggttagagagcctgtccagtttatacaaagtctgaggtgaagagtatttaatgtcgttttattgctctcaaagcatacagagcacttccaattactccaagaaataggaaataaaaaatatgactctaagtagaatttgcattaggtttaactttataggcatgggtgatttatacttagtagcctgaataaaatatgctcatatgcctcaaaataacaagtcagtctactccaaatttgatcagtttcaaacacataagggaagataatataatgttttgctattagtccatgtaacccaatgctcccattggtcaagaaatgttctctgacttttctttttactcagactgttgtcaaaccaatgataactatatacttcttaactccagtattgctaacataaaactaacactgtgtgttccatatacgcagatgtttgtgtgtttgtttggctagagacaaagcttctctggagtaaaaatgttagttatacatctagacacatagtggaataaaagttttagtttatacatctagacacatataccacattacactgattattttacttacgtaaaagacaagtaggtagaaatgaccccacacgaatacacttgcacaagtccctgagacatcacttcacaccaatacaccagagacagacccagatggatatccccagtaggctaggggagaaggttgatgagaggccggataacttggcagataaaagccatatgaataggtgggggatagagggatagagcatgtgaaagaggagaaaagtgaccacagcaggcaagcggtttagtatttacctaatatttgatctctgggcctcagaagtgtgttttctttaatcatttgctcattctcccttctcagttttaaagagacctgctctctgagcaagaagaagaagaccaaaagggaacagttgtcagagaagaggatccaagaagaatatgaaaaactgggagacattaggtaaaaatcagccattcctcttccctccttctccagcagaaacacagcaggtaaagtgagcacaggagcagccctgttcctgacaatccctgacactgggagaattttccacaactctgaatcaggcctttagaagatgctatttagtgccaaagccaagctggccca

SEQ ID NO: 284830 - DNA, 482 bp, Homo sapiens
ctcccctcccaagagtcggcctcactgacgtggctcctgtgtcctctgcttggttccagcaggtccaacgcagacctcaccactctgatgcacaacgaggtatggccttggggtttttctgtgctttggaatcacttgaaaatccctcagcacttcttcatggaaacccaagattcagaaccagattttcaacagctacagatccaccttagagttcctttcagtgaggattccattgacaaaatgttattattaaaaaggacacattggctgggcgtggtggctcatgcctgtactcccagcactttgggaggccacagcaggaggaccacttgaggccaggagttcaagaccagcctggccaacatggtgaaaccccgcctgtactaaaaatacaaaaattagctgggagtggtgatgggcaccggtaatccccactacttgggaggctgaggctggagaatcacttgaacctgggaggc

SEQ ID NO: 284831 - DNA, 681 bp, Homo sapiens
gatggtagctaagcatgtcatttactgttcttgttgcttgggtaataggccacaatgaggaagctagcacggtagtgggcaatgccaggtgggaaggtttgagttgtgaaagaagagccagggagcagagatggggaggaggcactgatggggtgggatgtgctttggtcacacatagcacagtcgggtgtgtcctcccttttgtccacagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgtgagtgcagtggggtccccaactctaaggtgaagaggagggaatagggtcttcaaaagatacaccctgtgatcacaggactcacccaagggaggagagattttggggttgggtccactcctgatctggaaggtaacagaattgatctttctttaggttgaaattggtaagtcagcagatatttattgagcatcagtttgatttagcacctgctgtgtgtcagaaacagtactaagcaccttacatttaatcctgtcaaccaccctacatcattggtattgattggtattgttgtcattgccattttcttttttc

SEQ ID NO: 284832 - DNA, 334 bp, Homo sapiens
ttgtgtaaattaaagtaaaaagcagtccccaataatgttttgttatactgcactccagttctaccagattttgtaactatcagatttcaatgattatagagaaggtagaggctgattgctgggattacaggcgtgagctaccgcgcccagcctgcgtagagcctttttctaagactaagggctggatgggaactagcatttcttacccctggatgtgacctgttttagctcagccgggagaatcctttttcgcaagaagttaataatatcttgtgacgtgaaaattatgtgaaactcagacttcagtgtccataaataaatattactggaacac

SEQ ID NO: 284833 - DNA, 3003 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284834 - DNA, 3402 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaaaaaaaacaaaaaaaaaaaaaaaaaaaaaaaaaaaaaaaaaaaaaaccccgggggccatttttcggggggggaaaaaagggcaaaaagcggcccaaggcggctcatcagatggtgtcctcgtgcgacccccatccttgctggacaaccacagaggggaacaacctgcggcccgggctccccccatcaagtggggcgagcgcctacaaaaactagcacaaagaaccgcaggtatcacccgcggcattaaaaccgcccagcgaacagagaacagcagtgcggcgcacgcggaagcaccgagcgcaagaaacgctcaacacgacgaccagaggacgccacaacacgacgcggcgaaaaggacatatgcgctcgcccaacaagacgccgcagacagcacagcgc

SEQ ID NO: 284835 - DNA, 4182 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaagctgtctttgttcaggctgctataacaaaaatataatagcctgggtggcttaaacaacaagtgtttatttctcacagttctggaggctatagacatccaagatgaaggcgctggcaaatgtggtgtgtggcaagggccagcttcctcagagaccatcttctcaccataacctcacatggtggaaagggcgtgagagctctctggggctccaccctcataaccccatcacctcccaaaggccccacgtcctaacactaccatagtgggggtgagcctttcaacacaggaatttgggggggacacaaacattcagtctctaataacagccctctaatgaaatgatgctgtggttaaatgagttctgggccaatttgtaaaagcctcaggacaggtctgaccctcacagacctagggaggggccaaccggaaggcaccaaagatccacatgatcctctttgatgtcttcatggaatggcatgtgtggattcacatgcagctcatttatgtgcgtgtccttaatagctaatggcacgtgcttatctcacgaggaaggaaatttttcctatttcataatctgagaaaacaagactcaaaaagggtgactaggttgaggtcacccagccaggaaatgacagagctgggatccacaggccaccgtctgaggtcagcctccttcccagctgctgggcgcatactcctgtgcacgtggatgccttgtggtcagggacgtatggtgcagccgacagacaggaccctgggtagagaagcccaggcactcggggagcctgcagccaaatttgggccaagtaggtgacgggggttgggagggcaggaggctctttcctaccagctagtggtagagcagatgacctgggaggggctggggggcccaacccctgtgataaccgtaactctcagtgagtgagcacttggactgtgctgggctttatggcccatcttcatcaattcatttgaatcctttcatgtccccatgaggtgggtaccattctgattttacagatcccaaagggctaaaaaataggccttagctcctgtagccgggttaaagcagaatcagatttcagatcatgtgtatgagtcgacagccagtgcctttaaccactccctaccctacatgtgtgccaggcatgtgctgtttgtctccacatgcatacagtg

SEQ ID NO: 284836 - DNA, 2719 bp, Homo sapiens
ggctaggtacgaggcctggtgttaatcggccgaggccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284837 - DNA, 2597 bp, Homo sapiens
ctaggctaggtacgaggctggtggtgattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284838 - DNA, 3059 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaagccagagaactgggtgcatctgagccagtggagatttgtgacttctccttcttctaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284839 - DNA, 3172 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaagaggaagagaaagcagaagtctcagggctggagacagctgaggggcatcagctggttcaaggtgtggagtgtgggcagtggagtgaaggcctggttacctctccagtgaagattagccccatagagcttactctatggggaagaacttttctgactccttcctgtctagggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284840 - DNA, 3063 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaagaggaagagaaagcagaagtctcagggctggagacagctgaggggcatcagctggttcaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284841 - DNA, 2449 bp, Homo sapiens
agcaaaaagattccatcccacaggccaagagctaaatcagtgttacctcctttagccagagaactgggtgcatctgagccagtggagatttgtgacttctccttcttctaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284842 - DNA, 2224 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284843 - DNA, 2660 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttagggcctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284844 - DNA, 2063 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284845 - DNA, 1830 bp, Homo sapiens
  misc_feature (52)..(52): n is a, c, g, or t
gggtcactttcagcgcgcacttacatgaagaacgcctctcttcgtctcagcntttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284846 - DNA, 1913 bp, Homo sapiens
aagaaagggtgttaaaattctagatcacatatggacccgggaaggttttctcaccctctgttagtgacatcgagtctcccactagacaaaataggtggaaaaatctctcgagggctcacattgttttgtcatcttcaggaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284847 - DNA, 1543 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgtgagtgcagtggggtccccaactctaaggtgaagaggagggaatagggtcttcaaaagatacaccctgtgatcacaggactcacccaagggaggagagattttggggttgggtccactcctgatctggaaggtaacagaattgatctttctttaggttgaaattggtaagtcagcagatatttattgagcatcagtttgatttagcacctgctgtgtgtcagaaacagtactaagcaccttacatttaatcctgtcaaccaccctacatcattggtattgattggtattgttgtcattgccattttcttttttc

SEQ ID NO: 284848 - DNA, 1137 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaa

SEQ ID NO: 284849 - DNA, 1787 bp, Homo sapiens
tagcaggctggtcggccggagtgtagggatctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagaaggatcccggggctgggagttcagggacctgggttcgaatgctggttccgctgctatctcgcttcgcactgtcgcgatccccttgctcggcctcaattttctcttttagaaagtgggcacctttctccgcgctcttccttccaacgcggtggttataaaggcacgaaagctcttcagaggacgcagaaagcacctggagctcctcaccccaattttcacccattgttagctggcacgagcacccagcagaggagtcagggatcacccctcgggtgcctggaacggttctttggacacctgagccggacctaggcacagcctgaagtcggggtctataattattccggtgctaaggggtaacttgttcacctacctccttggcaggaatattgagcccttcactcctgatgttccgactttaacagaagctacctttgagaataaggaatcctcagagctgagagggagtggacccgaattcctgtaccagctcggccacttaccttggctaagtcattttcttgttttgggccccagtgtcacagtgtttttgatttgtaagatgagggtttagggcttgtatcctaaatctggtcctcaagattcttgaagtcccccagtccatcggggagggagagcaacaaactgattttctaccccttcatttatttgtagttctaaattataaaagtaacactgcaagagtttggagtagagcctttttctttttctttctttttttttttctgagacagagtctcactctgtcgcccaggctggaatgcagtggcacgatctcggctcactgcaacctccgcctcccgggttcaagcgattcccctgcctcagcctcccaagtagctgggattacaggcgcccgctaccgcgcccggctaatttttgtatttttagtagagacggggtttctccatgttggtcaggctggtctcgaactcctgacctcatgtgatccgcccgcctcggcttcccaaagtgctgggattacaggcgtgagctaccgcgcccagcctgcgtagagcctttttctaagactaagggctggatgggaactagcatttcttacccctggatgtgacctgttttagctcagccgggagaatcctttttcgcaagaagttaataatatcttgtgacgtgaaaattatgtgaaactcagacttcagtgtccataaataaatattactggaacac

SEQ ID NO: 284850 - DNA, 451 bp, Homo sapiens
atacaaatgacaaggagaggggggttatggagccacagctggaaggagtctggtccttgaatcaccatttggagaaaaaacctgcagatgatcccatcctgcctgcacagcttctccaggggagatagacacacagaagcccacgagagtcaaataagagccataccttccaggtctccatgacacagacatcctccaccacacctgttaagaaagtcgaaatcgtcactgccacccacactggggttctgctttcctgattacacctttctcatctctatcacctatgccaggaacccaaacccaagtcttcccagctgtgtgcagaatcacagtggccacaccaagacaacaggtggggtcaatgtcacagcccattaggctgcatctgtgtccactggctccctcatcaaccacacaaaacaaaacagagactacacaacaatctact

SEQ ID NO: 284851 - DNA, 309 bp, Homo sapiens
tgaggacagcaacactctgtatcctgggtcacatttgtggctgaggcacgcccttaattccaagagacagggtcttgcaatcttgaatgactggctgaagtgatcctcctgcattggcctcccaaggtgctgggattacagcagcccccacaacctgccagacacccctgagttggaagaaacctcagagaacagttgtgtgccctcattctgcagaggaaaagactggggagccccagagaggagatgcttccacacaggcttgccctgtggctgtttaagccctacccaagccctctgggcattctt

SEQ ID NO: 284852 - DNA, 6356 bp, Homo sapiens
ctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacaactgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccgccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtacggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattgattcagttttttggtttttaataaatcagaagaccatgtagaaaacttttacatctgccttgtcatcttttcacaggattgtaattagtcttgtttcccatgtaaataaacaacacacgcatacag

SEQ ID NO: 284853 - DNA, 1874 bp, Homo sapiens
aggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggcta

SEQ ID NO: 284854 - DNA, 926 bp, Homo sapiens
tctcaacaacagttgctatactactcttaccaaagtggttttcctatgtacttctcaacagatcggccctttcttcaaataagagcagttggaacaacaaaagctgttcagttgtacccttggaatccacggaaatcctgggtagggaagctccagtaccaccaactggaaagactgggaatgcctagtagctggtactggccattgtcgtaggctttgtccactttgacaaactgaagacggggactcgactcaccttcgccagccacaggaggacctccagacgaggttaggtcgacttcatggtaactttagatcttgaaacctcacaggatttttcttctcttccccttgatctctcttccgcttactcaacaggaccggactcgccgcctttctttcccgtcagaaagggatcccttgcggacaagaccgaagtgagtagctggtttcccctacgtgtccttccggggctgggtgtctcgggagctcaggctgacaggagacctaactaccggcgactgagaccagcaggagcctggaggggcgcgcaccagggtggaggtttggtgccgggggttgagaacaacagtcaaaccctcttcttccctgtaccgcgcacctgccccctgggatgccgaacgaagtggcccctaaggcttctctgcaggtccaaccgaaacaggcctgaagttccaggatgggcgagaggatcctctttgagcgaaaccagccttctgcctggctggccctggtcaacacactcggaagaggccgatttggaggacagaacggaagaaaagacctaaaatatcgtaaacaggctatgagtccaccgtggatcgtaatagctaggggtggagagatcgttgctattactccccttattgcggggggtgcctcacccccctgagatgtggatcgtg

SEQ ID NO: 284855 - DNA, 1191 bp, Homo sapiens
accgatgccacttgctggacaagatgaacgaaaattcttcttgtataggtctttttgtggacacgtgcattcatttcccttgaggaataccaagtactggaattgttggatcataggatcggccctttcttcaaataagagcagttggaacaacaaaagctgttcagttgtacccttggaatccacggaaatcctgggtagggaagctccagtaccaccaactggaaagactgggaatgcctagtagctggtactggccattgtcgtaggctttgtccactttgacaaactgaagacggggactcgactcaccttcgccagccacaggaggacctccagacgaggaccggactcgccgcctttctttcccgtcagaaagggatcccttgcggacaagaccgaagtgagtagctggtttcccctacgtgtccttccggggctgggtgtctcgggagctcaggctgacaggagacctaactaccggcgactgagaccagcaggagcctggaggggcgcgcaccagggtggaggtttggtgccgggggttgagaacaacagtcaaaccctcttcttccctgtaccgcgcacctgccccctgggatgccgaacgaagtggcccctaaggcttctctgcaggtccaaccgaaacaggcctgaagttccaggatgggcgagaggatcctctttgagcgaaaccagccttctgcctggctggccctggtcaacacactcggaagaggccgatttggaggacagaacggaagaaaagacctaatagatgatcctcatccaatcacttaaaggcctgaatagaaccaaaagtctgacctgcccatgagtaagagagagctccttctgcctgattgcttcagctgagatatcagccttttcctgcctttggaattgaactgcaacactggctctttctgggcctcaagcctgccagcttttgagctgtaatcacaccatcatctctcctggttctcaggcctttggactcaaatcagaaacacaccatgggctctcctgtgtctcaagcttgccaactgtgatcttgagacttctcagcctccataatcacatgagtcaattgttggttctgtttctctggagaaccctaatccatcactttacatatttcttccattacacatattgtttcccagcatattaaataatttactgattata

SEQ ID NO: 284856 - DNA, 338 bp, Homo sapiens
ggcgagaggatcctctttgagcgaaaccagccttctgcctggctggccctggtcaacacactcggaagaggccgatttggaggacagaacggaagaaaagacctaaaaggtagaatctcatgatgtcgagatgttaaaaccctcaaatttttccaaatatgcagggggggaaagaggataataatattcccaatatcgcaagagttatacacccccgcgtgaaatggtccttaataatattccaaggcggaggggatgatgttactacatatatcgcagaaagtgtacaccccccagggatattattcccatgatcctggagggaagaggatattact

SEQ ID NO: 284857 - DNA, 720 bp, Homo sapiens
aacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaaattggaggctgttgattttgattcatttaaggtttaaaatctttattaattgcaaacagtgcaattatttatacttcacagtgccttcccagaccttccaccttaggttctgctgcaaaaagcaccagtgctgaagatgctgcaagcaccaaatcatagctcataaaatcaggtcctgagatagttacccataaagaggaatcctttgagtgtatgccattggtgagccgatgagcatggaccatagaagggctcaatgtagaagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284858 - DNA, 489 bp, Homo sapiens
agccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctc

SEQ ID NO: 284859 - DNA, 483 bp, Homo sapiens
  misc_feature (2)..(2): n is a, c, g, or t
cntgtatgttaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284860 - DNA, 443 bp, Homo sapiens
gatgagccggaccaacaaccggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcaggtataatgtaattgctaatttgttgatttctactccagtctgttttctgcatgtttactgtttgtctgtttgggagtgtttgccttttaaatttttatctggcaaagtataataactatttaaatgaagtactacggtgtattgtttgggtttttttgttttttataatgctttccagcatctgagtggtgaata

SEQ ID NO: 284861 - DNA, 471 bp, Homo sapiens
  misc_feature (455)..(455): n is a, c, g, or t
gcaccgtggtatgtttgttgtctccagatgccacttcagaaagatacctaaaataatctcctttcattttcaagtagaacaccttactttctggttgtgtagcattgggaataagatatttgtccaacagctccagaacatcattgcagatgtcctgcagttctgcctctatcttctcacggtactctttgcccatctgctgcttcttctcattcctctctgttttctgctcaatgctggagatgacacgccaggaagagcggcgggcgcctaccacattcttgtaggcaacagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagtaccncgtgctataaaacggt

SEQ ID NO: 284862 - DNA, 458 bp, Homo sapiens
  misc_feature (33)..(33): n is a, c, g, or t
  misc_feature (36)..(36): n is a, c, g, or t
cccgtgttacgacctctagtacggatccccagncgntgacagtggtggccttccagaaaggtcctgtatgttaactggaacacctgaatctgtccagtaagtttgaaaaatcttaaaaatctacttaagtaactacagcagaactctttgaattttgtctcttctctttgttactgctttattttacactgtggtttcgctgccaccttccctcaaagtcctccaactcctttgaagtttatgcctcatgcctttctcaggtggggttcatcatctgaatcattaaacacagaaaatggttaaaacaactccatatctactccagtctctacttgtaaagccacgtgtagcctggagaagaatgcacagtcaggtcgactggtgacacttaaaactcagacattaagctcaagtggactgttgtgttgcctgcatttccctagttccattcacttttc

SEQ ID NO: 284863 - DNA, 5884 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284864 - DNA, 5637 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcagctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284865 - DNA, 5676 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattctggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284866 - DNA, 5847 bp, Homo sapiens
  misc_feature (11)..(12): n is a, c, g, or t
  misc_feature (17)..(17): n is a, c, g, or t
  misc_feature (22)..(22): n is a, c, g, or t
  misc_feature (24)..(25): n is a, c, g, or t
gggctaggtannaggcnggtgntnnggagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284867 - DNA, 5829 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaagggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284868 - DNA, 2607 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcaaaaaaaaaaaaaaaaaaaaaaggaattcctctcagctgcacccagaacagggctggccagttggaaccacggagatctccttgccctagatgagcccagccctgttctgggtgcagctgagaaaatgagtgactagacgttcatttgtgtgctcatgtatgtgcgaagtatataaattggctcggaattccggaattccggaattcc

SEQ ID NO: 284869 - DNA, 5829 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcagaacgcgctggagttaggattacaggagacccatatatagtgcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284870 - DNA, 5689 bp, Homo sapiens
atcatggagcacatcaggaagctggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284871 - DNA, 5947 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatggctcttggacaagtccgagcagtacaacacactgggagggaatgccctctccttttaaagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284872 - DNA, 5254 bp, Homo sapiens
aacgttgggcccatcctatgcaaagtgtttctgagtaagacatagttcctttctttaaggagcctaaaatcctttggaaatcaaacgtaatataaggagcctgaactttggagtcatatgttcagtttcaaattttgtgctgcctattatatgtctggcattatacatatgctgtctcatttaatttttacatcgattaaggtcattatttatgaatgaggaaattaagttcaaaggggtaactaacttttaccaaagtgacttgtcagacatggtggagctgggaaaggatggggccaactttatgtcggtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284873 - DNA, 4974 bp, Homo sapiens
tgctgcgtcgttctagaggatcccaatgttgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284874 - DNA, 4648 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284875 - DNA, 3761 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcacttgccttcccagaccttccaccttaggttctgctgcaaaaagcaccagtgctgaagatgctgcaagcaccaaatcatagctcataaaatcaggtcctgagatagttacccataaagaggaatcctttgagtgtatgccattggtgagccgatgagcatggaccatagaagggctcaatgtagaagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284876 - DNA, 2399 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctc

SEQ ID NO: 284877 - DNA, 3910 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcactgtaagtacatcagaatgacaaattgatgaactgcaacagtatctttttgtcaatgttccacataatgcaaatgccatacgttgtgtgaatattatgttggaatacagtgctgatatcttggaaaaccataactgcctcttaatttaacatagaataatacatagttctgtattttttttaaagtgagcttaatgggtaagtattttttatatgctttagctatagctaaagaaaactgatacttaacaaagttgaatagtattattcactggtgctcctaaaatattgtttttcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagttcattgtagatattttgaaatgtttttgattgt

SEQ ID NO: 284878 - DNA, 3709 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatgccatacgttgtgtgaatattatgttggaatacagtgctgatatcttggaaaaccataactgcctcttaatttaacatagaataatacatagttctgtattttttttaaagtgagcttaatgggtaagtattttttatatgctttagctatagctaaagaaaactgatacttaacaaagttgaatagtattattcactggtgctcctaaaatattgtttttcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagttcattgtagatattttgaaatgtttttgattgt

SEQ ID NO: 284879 - DNA, 2843 bp, Homo sapiens
aacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaaattggaggctgttgattttgattcatttaaggtttaaaatctttattaattgcaaacagtgcaattatttatacttcacagtgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284880 - DNA, 2147 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagcgtcgcgctgggtcctctggcag

SEQ ID NO: 284881 - DNA, 2302 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagtgccttcccagaccttccaccttaggttctgctgcaaaaagcaccagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284882 - DNA, 2224 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcaggtataatgtaattgctaatttgttgatttctactccagtctgttttctgcatgtttactgtttgtctgtttgggagtgtttgccttttaaatttttatctggcaaagtataataactatttaaatgaagtactacggtgtattgtttgggtttttttgttttttataatgctttccagcatctgagtggtgaata

SEQ ID NO: 284883 - DNA, 2368 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtgtgagtatactttaaacttttaatttttagtgtagacccttagactgtagttaaattaagacgtttattcaaatacatcaaaggaaaatgtatcattactagtcagcatttatagatttcatgatatgtataatagatacaacgtgaagattttccagcaatgaaaataacctaattaaatgtgtagttacaggttttgagaacaaccttacatttgggtgtggctagataagaggagggtagtgttacctgtaggcatggtattagtgttggtgtaggattgtggaacatacttgaaggacatagttaacgggaattcattatttattaagattttactctactgaaccccagcgaggcaaacaagataaatcagatacatctgccactctacagtagaaattcataaatcctaggttttggactggctcacagatcatctgggggtattaaaatgtagactatttgggtgcttcccactcctacacataatatacagagacagacctgactcaaaatgtctgggatagggcccagcatctaattttacatagatgtttgggtgattctggtgcacagacaaatttggaaatttttcctccaggaaagttttctgttagaacaaaaaagtatgaaacgctttgactgcttttttgtaagtgaggcagacagtgtcttactggagtttttaacacaaagtgtgcagggggcatcttaaattattagaattgcctaggaaaaattatttttggtgtttgccatgctgtgaatggggtgcgtgcaaaacaaggttgacactgtttctgtcaacttgggaagacaaaaatagatgtacaaaagacgcttaaggaacgtcttacaaaatgtacacaaacattgtgagttctgttgtatggatagtttaatggttcaaaaaatgaa

SEQ ID NO: 284884 - DNA, 1493 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttaggcccccttacgccctggtcacaccgag

SEQ ID NO: 284885 - DNA, 983 bp, Homo sapiens
tgctctagaggatcaccgtcttagtcctctcagaaaggcctggcttgtaggacttggaagcaggccctaaagcgcatcggcaggtcagagctttgtgttcaggaacactgggatctgcttagagctggtgtagtcgctctaaaactgcacactgcttttcccaatcagtttacacaaaaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtatttgcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattaaaaaaaaaaac

SEQ ID NO: 284886 - DNA, 924 bp, Homo sapiens
ggtaatagagcttcgacggcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggtattgttatttttgtgaaatggctacttttgatctgttttgatgcccatttttgtccacttcttttgttaatatatattatttctatgattgtaacaggaacgggctggagttaaaatggttatgattcaagacgggccgcagaacactggtgctgacaaaaaataaaaattattattgatttt

SEQ ID NO: 284887 - DNA, 194 bp, Homo sapiens
gtccccattccaagatttgctgttggcattgtaataggaagaaatggagagatgatcaaaaaaatacaaaatgatgctggtgttcgcattcagtttaagccaggtgagtacatataataatcttgtaagtgttggcagcagtgagttttgacatacatttattgtttaattaattttgtttctttgttttgaag

SEQ ID NO: 284888 - DNA, 5533 bp, Homo sapiens
aagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagcgctcggtggcctccggtagctggcaggcccgggcgcggcctcgtgccgaattcggcacgagggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttataaatggagcacttagaaatttgttgttctgcacttaacctagagagagaaaaaatgctttttctttgtgaaaaatctgaattcctgtcctgaccttctgtgatgtggaaaccctaggctctgagacacactctctggtgtctgagacagaaccaaagcaataacgttgtgatgcccacaggcctggagccagctagcgaccttgtgccgcccagctgtccatggcccgtgcagagcagaggacagtgagtgtctgcactgagaaccttaaaccacagttgaacatacccacacctgtttgtcttaagctatagtgtaaaaacaaagtttgggctctgaaaatttaactgaaaaagatttccttgtttttgtaataggtgagataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgcttgaaattcttgagcagggatcttataaagggccagaaataagatgtgtggttcacatagatagtgagcgtaacatctgtattaaacataggagagaagtttataaagggcattggcaataaactctttgttgcagctgttttccaagcagtgtaaatactttttcctgtgattatgtatagccttggaatggcaccttttaactaacccatatgtgtttggtttcaatggttttttatattcagatgtatatatggtgctcactttaggatcagcagtgttgaccatttatgctgcatagctgtattatagccttattagttgtgtggttgacccttggggtatacaaatgtcagtctgagtggtgtcttactcctttgtttataagtgaatgattgtgcatgttttgtatgtcatagtatgtcgtcacataaaagggagggagcgaaaaaccattacattaagataatattggaccaaactacttacttgctctaaacagttacttgtaccccttaacctgtcttcaaaagttgcatatagttacagtagtgtataaattaaatattgtggaaaaacagtcttgtatttttctgtatgtgtgtatatatatataattatgtacttctggcaattctatctgtatttaaagatgtgacaatcttgacaccaattttaagaatagctgtgagaccgaattaaagataatccctaccaagtgaaaattgatgtgtgttaagagggtacagaattatcaactgatttggtcagttgcttccaatgctggttgatttccctcattgtgtaaacattgacaggtatgtgacaaatgggaaaaaaaatccaaataataaagtgacatattggtgttcagcaataaaaaaaaaaaa

SEQ ID NO: 284889 - DNA, 511 bp, Homo sapiens
caccgtaacccttgttcactattatttcttcattccagtggaataatttttctgacctgtctacctggaacaatctctgttcactctgaaatccctgtttattaaatttcgcttaaaggagttgtaattcacagaaggcagaaggataataggagactgggttactaaagacaaattttactatttttatacatgtgtctagatccagccttagagtatatactttgactttaagcaaaattcaaacaaatagaactaaacctgtatctttttctttattttcttttaggaaaaagaagcaactaacaaaacactgtgataataaggattattcagtatgcagtttgcagggtatgtcttggagacagtacaaattcacctttactttatataagccacatcttaacattgggcattgatgttcagaatgacttttgggagctgcaagatcctcagagatcaaaaaaaatgatttagttactttgacgcgggggatcgtctagtagcgcaa

SEQ ID NO: 284890 - DNA, 1224 bp, Homo sapiens
gtccaatattttaaagtatgtctttgatttatagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagagtaagtaaaacaaagtatgtggaaaccttaaggactcagattaaaaccagaagttttaattccattaatatgtcaagaaaatttgagaggacttcaaacatccaagcatctgggttgattttaatttttgaatttaatatttctgctgttgtttcagagtgttcggtcggcgggggtgggggtggttagcccctgaatatgatctgaaatttaatattagagtacaaaatgtattcatctatttcttattcaagaaatctattacatgcctcttcaaccttcaggagtggtggttatttcacttgaactgaagaaataccatgggaactacctttctctgcatgagcaaaaagcaagatcacctggaattgttttaagttccagagaagagttagggcattttctttcctgaatagaccatcaacacactattttagggtttacatagtatgtctcataattttcttcacacaccttctgctaattgactaaagagctgtttaggtttatgtgactatgggaagccagcataaaaagtatactcaattatttggaatttaaagtagtacatagtactatgatatgtgtagtgagaaatacagtaatggaatagaactgttggaagttcagtattgacattttaagtgacattttttaatgagctcagctgagattatagccactacttacaggactttgctgtagaaacagagttttgagtttctcctatcagctggtaagaaggaaatctgattgcccaaggactttttttctctaaatgaagccccatctcaggtggatgtttaagaacttaggtattcaaggccgaggcaggcagatcacaaggtcaggagatcgagaccatcctgacttacatggtgaaaccccgtctctactaaaaatacagaaaattacctgggcgcctgtagttccagctactcaggaggctgaggcgggagaatggcgtgaaccctggaggtggagcttgcagtgagccgagatcgcgccactgcattccagcctgggcgacagagcgagactctgtctc

SEQ ID NO: 284891 - DNA, 5349 bp, Homo sapiens
caccgtaacccttgttcactattatttcttcattccagtggaataatttttctgacctgtctacctggaacaatctctgttcactctgaaatccctgtttattaaatttcgcttaaaggagttgtaattcacagaaggcagaaggataataggagactgggttactaaagacaaattttactatttttatacatgtgtctagatccagccttagagtatatactttgactttaagcaaaattcaaacaaatagaactaaacctgtatctttttctttattttcttttaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttataaatggagcacttagaaatttgttgttctgcacttaacctagagagagaaaaaatgctttttctttgtgaaaaatctgaattcctgtcctgaccttctgtgatgtggaaaccctaggctctgagacacactctctggtgtctgagacagaaccaaagcaataacgttgtgatgcccacaggcctggagccagctagcgaccttgtgccgcccagctgtccatggcccgtgcagagcagaggacagtgagtgtctgcactgagaaccttaaaccacagttgaacatacccacacctgtttgtcttaagctatagtgtaaaaacaaagtttgggctctgaaaatttaactgaaaaagatttccttgtttttgtaataggtgagataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgcttgaaattcttgagcagggatcttataaagggccagaaataagatgtgtggttcacatagatagtgagcgtaacatctgtattaaacataggagagaagtttataaagggcattggcaataaactctttgttgcagctgttttccaagcagtgtaaatactttttcctgtgattatgtatagccttggaatggcaccttttaactaacccatatgtgtttggtttcaatggttttttatattcagatgtatatatggtgctcactttaggatcagcagtgttgaccatttatgctgcatagctgtattatagccttattagttgtgtggttgacccttggggtatacaaatgtcagtctgagtggtgtcttactcctttgtttataagtgaatgattgtgcatgttttgtatgtcatagtatgtcgtcacataaaagggagggagcgaaaaaccattacattaagataatattggaccaaactacttacttgctctaaacagttacttgtaccccttaacctgtcttcaaaagttgcatatagttacagtagtgtataaattaaatattgtggaaaaacagtcttgtatttttctgtatgtgtgtatatatatataattatgtacttctggcaattctatctgtatttaaagatgtgacaatcttgacaccaattttaagaatagctgtgagaccgaattaaagataatccctaccaagtgaaaattgatgtgtgttaagagggtacagaattatcaactgatttggtcagttgcttccaatgctggttgatttccctcattgtgtaaacattgacaggtatgtgacaaatgggaaaaaaaatccaaataataaagtgacatattggtgttcagcaataaaaaaaaaaaa

SEQ ID NO: 284892 - DNA, 5140 bp, Homo sapiens
aggcgcagctacccggcaccccctccccgcggccggcagcccgctcggtattatgattagcgctgggtgcggggtttcggcggccgggagggagttgtcggcgccgcggccgctgcggacggacgctcgcctgccggctgagatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttataaatggagcacttagaaatttgttgttctgcacttaacctagagagagaaaaaatgctttttctttgtgaaaaatctgaattcctgtcctgaccttctgtgatgtggaaaccctaggctctgagacacactctctggtgtctgagacagaaccaaagcaataacgttgtgatgcccacaggcctggagccagctagcgaccttgtgccgcccagctgtccatggcccgtgcagagcagaggacagtgagtgtctgcactgagaaccttaaaccacagttgaacatacccacacctgtttgtcttaagctatagtgtaaaaacaaagtttgggctctgaaaatttaactgaaaaagatttccttgtttttgtaataggtgagataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgcttgaaattcttgagcagggatcttataaagggccagaaataagatgtgtggttcacatagatagtgagcgtaacatctgtattaaacataggagagaagtttataaagggcattggcaataaactctttgttgcagctgttttccaagcagtgtaaatactttttcctgtgattatgtatagccttggaatggcaccttttaactaacccatatgtgtttggtttcaatggttttttatattcagatgtatatatggtgctcactttaggatcagcagtgttgaccatttatgctgcatagctgtattatagccttattagttgtgtggttgacccttggggtatacaaatgtcagtctgagtggtgtcttactcctttgtttataagtgaatgattgtgcatgttttgtatgtcatagtatgtcgtcacataaaagggagggagcgaaaaaccattacattaagataatattggaccaaactacttacttgctctaaacagttacttgtaccccttaacctgtcttcaaaagttgcatatagttacagtagtgtataaattaaatattgtggaaaaacagtcttgtatttttctgtatgtgtgtatatatatataattatgtacttctggcaattctatctgtatttaaagatgtgacaatcttgacaccaattttaagaatagctgtgagaccgaattaaagataatccctaccaagtgaaaattgatgtgtgttaagagggtacagaattatcaactgatttggtcagttgcttccaatgctggttgatttccctcattgtgtaaacattgacaggtatgtgacaaatgggaaaaaaaatccaaataataaagtgacatattggtgttcagcaataaaaaaaaaaaa

SEQ ID NO: 284893 - DNA, 4235 bp, Homo sapiens
ttgaaatttcaggtgaattttatttgtagtaatatacctttatgtgatctaagaaccaaagaaacaagacgtggtgttcaggttttgctttgccaataacctccatgggcttctaaaaaatgtttagtataaagcttttgtatagaaaagatggagtagctctttgccctattttcttttctgacacctgtgatgaagttttcacttggccaataagccacaaactgaaccatgtttcaaaaccacatttgcccttctggtggccttgctgatgtttacaggatgttgaatgggtttgcaaggctgctgcttttttctttaagtctgtagattttgtcccagtaagttcattgtgatgtactttactatcatctgcataatgattatatggcttttttccccccaatctatctgttacataggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttataaatggagcacttagaaatttgttgttctgcacttaacctagagagagaaaaaatgctttttctttgtgaaaaatctgaattcctgtcctgaccttctgtgatgtggaaaccctaggctctgagacacactctctggtgtctgagacagaaccaaagcaataacgttgtgatgcccacaggcctggagccagctagcgaccttgtgccgcccagctgtccatggcccgtgcagagcagaggacagtgagtgtctgcactgagaaccttaaaccacagttgaacatacccacacctgtttgtcttaagctatagtgtaaaaacaaagtttgggctctgaaaatttaactgaaaaagatttccttgtttttgtaataggtgagataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgcttgaaattcttgagcagggatcttataaagggccagaaataagatgtgtggttcacatagatagtgagcgtaacatctgtattaaacataggagagaagtttataaagggcattggcaataaactctttgttgcagctgttttccaagcagtgtaaatactttttcctgtgattatgtatagccttggaatggcaccttttaactaacccatatgtgtttggtttcaatggttttttatattcagatgtatatatggtgctcactttaggatcagcagtgttgaccatttatgctgcatagctgtattatagccttattagttgtgtggttgacccttggggtatacaaatgtcagtctgagtggtgtcttactcctttgtttataagtgaatgattgtgcatgttttgtatgtcatagtatgtcgtcacataaaagggagggagcgaaaaaccattacattaagataatattggaccaaactacttacttgctctaaacagttacttgtaccccttaacctgtcttcaaaagttgcatatagttacagtagtgtataaattaaatattgtggaaaaacagtcttgtatttttctgtatgtgtgtatatatatataattatgtacttctggcaattctatctgtatttaaagatgtgacaatcttgacaccaattttaagaatagctgtgagaccgaattaaagataatccctaccaagtgaaaattgatgtgtgttaagagggtacagaattatcaactgatttggtcagttgcttccaatgctggttgatttccctcattgtgtaaacattgacaggtatgtgacaaatgggaaaaaaaatccaaataataaagtgacatattggtgttcagcaataaaaaaaaaaaa

SEQ ID NO: 284894 - DNA, 2946 bp, Homo sapiens
gccggtcgactactagagcgattctctgtggtgcagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctagacacttttctttcccagccgaaaagcctattatgtaatttttacattcataattttaatgtggatgatcaggattaaatcaagatatatatctggaacctcttataaatggagcacttagaaatttgttgttctgcacttaacctagagagagaaaaaatgctttttctttgtgaaaaatctgaattcctgtcctgaccttctgtgatgtggaaaccctaggctctgagacacactctctggtgtctgagacagaaccaaagcaataacgttgtgatgcccacaggcctggagccagctagcgaccttgtgccgcccagctgtccatggcccgtgcagagcagaggacagtgagtgtctgcactgagaaccttaaaccacagttgaacatacccacacctgtttgtcttaagctatagtgtaaaaacaaagtttgggctctgaaaatttaactgaaaaagatttccttgtttttgtaataggtgagataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgcttgaaattcttgagcagggatcttataaagggccagaaataagatgtgtggttcacatagatagtgagcgtaacatctgtattaaacataggagagaagtttataaagggcattggcaataaactctttgttgcagctgttttccaagcagtgtaaatactttttcctgtgattatgtatagccttggaatggcaccttttaactaacccatatgtgtttggtttcaatggttttttatattcagatgtatatatggtgctcactttaggatcagcagtgttgaccatttatgctgcatagctgtattatagccttattagttgtgtggttgacccttggggtatacaaatgtcagtctgagtggtgtcttactcctttgtttataagtgaatgattgtgcatgttttgtatgtcatagtatgtcgtcacataaaagggagggagcgaaaaaccattacattaagataatattggaccaaactacttacttgctctaaacagttacttgtaccccttaacctgtcttcaaaagttgcatatagttacagtagtgtataaattaaatattgtggaaaaacagtcttgtatttttctgtatgtgtgtatatatatataattatgtacttctggcaattctatctgtatttaaagatgtgacaatcttgacaccaattttaagaatagctgtgagaccgaattaaagataatccctaccaagtgaaaattgatgtgtgttaagagggtacagaattatcaactgatttggtcagttgcttccaatgctggttgatttccctcattgtgtaaacattgacaggtatgtgacaaatgggaaaaaaaatccaaataataaagtgacatattggtgttcagcaataaaaaaaaaaaa

SEQ ID NO: 284895 - DNA, 2420 bp, Homo sapiens
aagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagcgctcggtggcctccggtagctggcaggcccgggcgcggcctcgtgccgaattcggcacgagggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagagtaagtaaaacaaagtatgtggaaaccttaaggactcagattaaaaccagaagttttaattccattaatatgtcaagaaaatttgagaggacttcaaacatccaagcatctgggttgattttaatttttgaatttaatatttctgctgttgtttcagagtgttcggtcggcgggggtgggggtggttagcccctgaatatgatctgaaatttaatattagagtacaaaatgtattcatctatttcttattcaagaaatctattacatgcctcttcaaccttcaggagtggtggttatttcacttgaactgaagaaataccatgggaactacctttctctgcatgagcaaaaagcaagatcacctggaattgttttaagttccagagaagagttagggcattttctttcctgaatagaccatcaacacactattttagggtttacatagtatgtctcataattttcttcacacaccttctgctaattgactaaagagctgtttaggtttatgtgactatgggaagccagcataaaaagtatactcaattatttggaatttaaagtagtacatagtactatgatatgtgtagtgagaaatacagtaatggaatagaactgttggaagttcagtattgacattttaagtgacattttttaatgagctcagctgagattatagccactacttacaggactttgctgtagaaacagagttttgagtttctcctatcagctggtaagaaggaaatctgattgcccaaggactttttttctctaaatgaagccccatctcaggtggatgtttaagaacttaggtattcaaggccgaggcaggcagatcacaaggtcaggagatcgagaccatcctgacttacatggtgaaaccccgtctctactaaaaatacagaaaattacctgggcgcctgtagttccagctactcaggaggctgaggcgggagaatggcgtgaaccctggaggtggagcttgcagtgagccgagatcgcgccactgcattccagcctgggcgacagagcgagactctgtctc

SEQ ID NO: 284896 - DNA, 3151 bp, Homo sapiens
aagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagcgctcggtggcctccggtagctggcaggcccgggcgcggcctcgtgccgaattcggcacgagggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttaggcagtcatggccaaccaaaattgatgtaccccaggaccttgaggatgacctcacggccactcctttgtcccacgcgactgtccctcagtctcctgctcgggctgctgacagtgtcctcaatggccacaggagcaaaggcctgtgtgactcagctaagaaagatgacctccctgagttggctggaccagcactctctacggtgccacccgcaagcttaaaacccacagccagtgggcggaagtgtctgttcagggtggaagaagatgaagaggaagatgaggaggacaagaaacccatgtccctctcaacacaagtggttttgcgccggaagccatctgtaaccaaccgcctgacatccaggaagagtgcgcccgtcctcaaccagatctttgaggaaggggaatctgacgatgagtttgacatggatgagaatctgcctcccaagttgagcaggttaaagatgaatatagcttctccaggtacagttcacaaacgctaccaccggaggaaaagtcagggccggggctccagctgcagtagttcggagaccagtgatgatgattctgaaagccggcggcggctcgataaagatagcgggttcacctactcctggcaccgacgggatagcagcgaggggccccctggcagtgagggggatggcgggggccagagcaagccaagcaatgccagtggaggggtggacaaggccagccccagtgagaacaatgctggtgggggcagtccctccagcggctcgggtggcaaccccaccaatacatcgggtaccacacgccgctgtgccggccccagcaactccatgcagctggcctctcgcagtgctggggagctcgttgagagcctcaaactcatgagcctctgcctcggctcccagcttcatgggagcaccaagtacattattgatccacagaatggcttgtcattttccagtgtgaaagtccaagagaaatctacgtggaaaatgtgcattagctccacagggaatgcagggcaggtccctgcagtgggcggcataaagtttttctctgaccacatggcagataccaccactgaattggaacggataaagagcaagaacctgaaaaataacgtgctgcagctacctctgtgcgaaaagaccatctctgtgaacatccagcggaaccctaaggaggggctgctgtgcgcatccagcccagccagctgttgccatgtcatctgactgtggccccatctggccgctagcacgcttcctgctcagagcagtgaagaccggctcacttcactgttccatttggttttactattttaaagtgggcgttaggagcaattatttattacctttccatttgttcgcctgatgatgtgacaatgcatggtctttgtgcatgctgctaacgcccactttaaaaaagtaaaaaaagttggcggccg

SEQ ID NO: 284897 - DNA, 2064 bp, Homo sapiens
aagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagcgctcggtggcctccggtagctggcaggcccgggcgcggcctcgtgccgaattcggcacgagggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtagatatttggagtctgggagtgatccttttcatgttggtgtgtgggcagccgccctttcaagaagccaatgacagtgaaacactgacaatgatcatggattgcaaatatacagtaccatcccatgtgtctaaagagtgtaaagacctaatcacacggatgctacagagagatcccaagagaagggcttctttagaagagattgaaaatcatccttggcttcagggagtggacccttcaccagctacaaagtataacattccccttgtgtcatacaaaaatctctcggaagaggagcacaacagcatcattcagcgcatggtgcttggggacatagcggatcgagacgccattgtagaagccctggaaaccaacaggtataaccatatcacagccacatacttcctgctggctgaaaggatcctgagagaaaagcaagagaaagaaatacagaccagatctgcaagcccgagcaatatcaaggcccagtttagagggtcagctggcctggatttattgaagctctgcctccacttcttgcagtgactgcatctatccaccccctgggccgtgggactctccggtgaaaacaggagtttttgcatttctgaggactgatggctccaccagattcaccaaccagtcctgtggccctcacccaggaactgactcagctgaagaagacagctttgactcactgtgatttcacctctgatccaattagtcggtactccccattccctggccccctacccaccaaactatccttgaaaaactctagtctgaatttttggggagactgatttgagtaataataaaactgctatcatgttcaaaa

SEQ ID NO: 284898 - DNA, 1489 bp, Homo sapiens
aagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagcgctcggtggcctccggtagctggcaggcccgggcgcggcctcgtgccgaattcggcacgagggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattttttgtattcaccagatattcttatatgagaagatctattttaaacagtctaaatattttttcttctgttggaccagcatggcaggatttaagcgagggtatgatggaaagattgctggattatatgatctggataaaaccttgggtcgaggccattttgccgtggttaaacttgccaggcatgtctttacgggtgaaaaggtggcagtaaaagttattgacaagacaaaactggacactctagctactggtcatcttttccaggaagtgagatgcatgaaactagtgcagcatcctaacatcgtccgcctttatgaagttattgacacccagaccaaactatatcttattctagaacttggggatggaggagatatgtttgattatataatgaaacatgaggagggtcttaatgaagacttggccaagaagtattttgctcagatagttcatgctatatcttattgccataaactccatgtggttcacagagacttaaaaccagagaatgtagtcttctttgaaaaacaaggtcttgtaaagttgacagactttgggttcagcaacaaatttcaaccagggaagaagctcactacaagctgtggatctcttgcatattccgctccagaaattctgcttggtgatgagtatgatgcacctgcagtaggtaggtaacctcggtccagtatttggccatttgaattctgccagctagagttggtcagatcggttgtttatctaaaaatgatttctagagaattttaaatcgctccttaactaccaaattgggtttcataaatgcctatatgcctaaagctggacattaaatcatattatcaccctttatatggcaaatgtctaaagtatatttgtgagtacaaaggaaaatgagtaagttatcatttaaagtaatcttcttttctgtt

SEQ ID NO: 284899 - DNA, 3212 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284900 - DNA, 975 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggccgtcctggggacctcatactctgtaacatgtgccctaccacctccttataggggtagggcgacccattaaaggctaagatgattaaatgcatggctcataagtaatagaattgcgatttttctgtcttaaagatttact

SEQ ID NO: 284901 - DNA, 3128 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284902 - DNA, 3292 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgtgctctgcttttctcctcccccatcccttcctcattccttcaaccccttcccctaaccaccaccaccaccaccttttaggaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284903 - DNA, 3499 bp, Homo sapiens
  misc_feature (3498)..(3498): n is a, c, g, or t
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgccaaaaaaaaaaaaaaaaaaaaaaaaactttttggggggcttgggcccttggaaaggtttttaagacaccttccgttgggcgcgcggggccccgttggcttaggtgacctgggccaaaggtgtcccaagggagaccggggcagggactagggctgggtttcctcccctttaaaaagggccggggggaaccggagggtctggacatctccagtgggagcccgggggcccatggggtctctttcacggggtgtcccaggagccggatttaataccctccgggtggggng

SEQ ID NO: 284904 - DNA, 3171 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284905 - DNA, 2225 bp, Homo sapiens
tgagatctgccttctctatcccaatggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284906 - DNA, 3139 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagaacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284907 - DNA, 3104 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284908 - DNA, 3055 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagaacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284909 - DNA, 1675 bp, Homo sapiens
gatgatgtttccttttgtatccagtttggtttttctccctatgaaggtctgtaatactagggcagccatgaatgggaaagaatctcatagcctgcaatgggaaggaagcaaaatgggaagctccacacctgagagttgggggagagcaggagcagggaggctcccagctgacagattgtgtgtgcacacagatggttctccctggaaagttctgctggcagatcctggcattggggaagttgggaaaatacatgaacactgtctgctggggactgggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284910 - DNA, 1655 bp, Homo sapiens
gaagtttttctctctcatcaacctctctcactctctcactctatccttcctccaacccacccatacccttcttatttaaaaatcattttaaaaaacatgaacagggagatcaaaattaatatgcagggcagccatgaatgggaaagaatctcatagcctgcaatgggaaggaagcaaaatgggaagctccacacctgagagttgggggagagcaggagcagggaggctcccagctgacagattgtgtgtgcacacagtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgttttttttgcttttttaaacttgaatttttttaatttacactttttagttttaattttcttgtatatttggctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattg

SEQ ID NO: 284911 - DNA, 1513 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatttcccatttttagagtcaattcactcaaaagatcaggatgccagtatgcaggcagcctcacctccacctccccagtaagcctccctaagagggctcactttacctctttggaaaattcccagccttccaaatctacacccgcttctctctcctttagaggacaagactaaggaggagaaaaagaaactgggagaggagaggggacgagaaactgaagaattccacgacagcctcaccgtttatgggtttcactggtgtcttggtaactgcgggacatctggctgcttgcgaa

SEQ ID NO: 284912 - DNA, 480 bp, Homo sapiens
agagagacaaagtgtctacccacggtgtcaatattgatgatgttaaatatgaagctatagagacaaaggtcaccaggtcactattttctcccgttctcttgctttctgactttgtttctagatagagatggtgaagagggagagagaatgagtcatctttacctctttgttgaccacctgcctgtacttccacatcacattcatctgtgtgttcatggtacaatctgtgacatgacagtatacctctcttcttccagggtaagaaaaagaagaggaagagagagaaactacaggaatctgcatcaggtaggcaccatgagactttccagtcaatcctcaggcttctgacaaacaccttttaaggcagtttgcatctctctacacactgctttcttctgtgactgtaactcatgatgctttaactctgctttttcttcctgaaattcttttaaaaatttaaaagacccttcttttaaatgt

SEQ ID NO: 284913 - DNA, 440 bp, Homo sapiens
aaggtctaaagatttattagcttctcaaagtgctccttaaccccctgcaaaagttaagaacctctattctgaaagaggaatgatcacctgtgctgtgtgttcagcttcttctgaggggaccagagaagtcctcagcctcagagcccatctggagcatcttcacaatgccaagtccatttctacttggtgttcatagttctataatgacaggtccactttctcaaaccaaagggttttattctcagtcactgagtagataggaagccctattggatgggttgtttgcctctcagtgttttgtcaaatgagtcaataactgctcttccaagttggtggtggtctggggtgagagggttgtcgccatcctgagtgtagccatgtgagcaggtgctctgcttttctcctcccccatcccttcctcattccttcaaccccttccc

SEQ ID NO: 284914 - DNA, 2156 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatgtaagcccctcctccataccagtggctctccactctcactcattcgctcttttgcgttcaagaaggaaatgtgttttaggtgtatataatgctggtactacttattttttggaagttaatgaactttgtaataaggatttcatggatatattgcattatgaaagcttcgagctatctttttttttttgctatgggtgctaatgaatgcttttaaataaaatttttgaaataaac

SEQ ID NO: 284915 - DNA, 1408 bp, Homo sapiens
gtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacagaatttttctgcctcttttggtggcattaggttttgattcacttgtcaagacgtgatcctgtcatactgatttgtgtctctgtatctggagccagaattgaaaaccacctttgactttcctgttcttcctcttctgttaatggaatcatgcatttacaacttcccaaataaacctgtgattcttacaa

SEQ ID NO: 284916 - DNA, 876 bp, Homo sapiens
gaggacggcgctcgctagttctcccaggtcgcggtacacggtgacgaacgggcggggaggatcgtcggctgctgatacgggctgatcgcatggtgctttgagattcgcagtcgatatcccgtctccacgcaactctgtgtcgagcatgttcacgcatgggtgccaggattcaacctcatcttccctaattcaatgacactcacctgcccacacgaggacgcaccaggccatgggacttgatgaagacacagtcgccaaccttcagccacatgtcattgtaatggagctgctcaaagtagtggcaacctggttcaccattggacatttccacagggacatcttctttttcctgttgtaaagaaaactggctgaagaaaggtagttgataatcaaggaatagagaaggttgtgaaatcaagattatcttggctttgcaaaacaaactggaaatttcttgttctccctgctctgaaacagcttcaacagtataataatcataggtcccttaaagaaaaagtcacctatggaactgtctgacctcagtactctttggggtcagttctatgatactttaaaaaatttcttcatgttgttgtacattctgtattatatctcttcttgattccattttggtaatttgtaatatcctagacaattagccattttatttaggttttcaaatttattagcagaaatatacagtctttacatttcttccacatttatttatttatttattttttgagacagagtttcgctcttgttgcccaggctggactgcaatagcacgatctcggctcactgcaacctctgcctcctgggttcaagcgattctcctgcctcagcctcccgttgggattacaggcacccaccacc

SEQ ID NO: 284917 - DNA, 510 bp, Homo sapiens
aataagactgagttgcagttttttgtttttatttttcaggttgtgaaatcaagattatcttggctttgcaaaacaaactggaaatttcttgttctccctgctctgaaacagcttcaacagtataataatcataggtcccttaaagaaaaagtcacctatggaactgtctgacctcagtactctttggggtcagttctatgatactttaaaaaatttcttcatgttgttgtacattctgtattatatctcttcttgattccattttggtaatttgtaatatcctagacaattagccattttatttaggttttcaaatttattagcagaaatatacagtctttacatttcttccacatttatttatttatttattttttgagacagagtttcgctcttgttgcccaggctggactgcaatagcacgatctcggctcactgcaacctctgcctcctgggttcaagcgattctcctgcctcagcctcccgttgggattacaggcacccaccacc

SEQ ID NO: 284918 - DNA, 446 bp, Homo sapiens
catggcctaagaggagaagggctacttaaaggagggctagacaggcaaaggcccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttc

SEQ ID NO: 284919 - DNA, 633 bp, Homo sapiens
  misc_feature (340)..(340): n is a, c, g, or t
  misc_feature (399)..(399): n is a, c, g, or t
  misc_feature (578)..(578): n is a, c, g, or t
ccttacggctaggtacgaggctgggtgttgacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatgctcccacatccgacatgcctgggaccacgctaaatcggtacggcagaacctggccgagatggggttggctgtggaccccaacagggcggtgcccctccgtaagagaaagcggtcaaggcagcaacaggggtcgcaagggcccaantggcagggtttgggaaccattaaggcacggcacgacaggccccttaaactatgcagccntttgggtaaacgggggaaaagggcccccctaaatggttgggccttgagagaagatgagaaccccctttggggccaaggggccccaaggccacaaggccccccaaggcccccttttttccccaagggaaaacacacaccaggcgaacaaccaaggcggacaacaacccaaattataaccnttcccccttgggttttccccttcccggcgggcggaaaaacccccccttttcccga

SEQ ID NO: 284920 - DNA, 1378 bp, Homo sapiens
  misc_feature (1284)..(1284): n is a, c, g, or t
  misc_feature (1287)..(1287): n is a, c, g, or t
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttcnaanaaaaaaaaaccgggcttatgcgggcggaaaaggtataaggccggcctagtccgccccttgtcagggaacggccagggtatcaacgagaggc

SEQ ID NO: 284921 - DNA, 624 bp, Homo sapiens
ggaagacggttgtgggcggtgccatgttcttcatcggtttcaccgcgctcgttatcatgtggcagaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttc

SEQ ID NO: 284922 - DNA, 2126 bp, Homo sapiens
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggtgagcggctcaggccccgtgggctggctgggaaggcgccctggaccattcgcggcttgatctgcttgcgcagcacctgtttcctgaaaccgagtgcaaagaaagggaggcaaaagagactctaggaaatggatcccattgacagggatctaacttgaatgaatgcttatggcaaggatagactgagtgaccttggttccagtctcactcacagataatgtcttgctcgcatggtgttttttggtttgttttgttttcaagacagagtctgctcagtcacccaggatggaagtctatttttggcttcctttaacagttgaaagatccggctacactggacccctgggcccaagtaggattagctggctatgatgggtcatgagctcctcagctggccccagctcctccctggcccgctggactctcaggccttcctggtcttttttttgagacagaatctcgctctgtcacccagggtggagttcagtggtgtgatcatggctcaccgcagcctcatcctcccgggctgaaacagtcctcctgcctcggcctcccaagtagctgggaccacaggatggttaatttattgtttttggagagacagggtctcactgggttgcccagggtggcctggaactcctgggctcaagagatcctcccacctcggcctcccagagtgttgggattacaggcatgagccactgtgcccggtgcaccacagcctttgaggtcaggattctggacctcagggatagatagcaagtggcttgcctaattcaggatgagttcagatttgagcctttgcctgtctagccctccttaaagtagcccttctcctcttaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttc

SEQ ID NO: 284923 - DNA, 1196 bp, Homo sapiens
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagattcggagtaagatcaacgtctataaacgcttttacccagcagagtggcaagacttcctcgattctttgcagaagaggaagatggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttc

SEQ ID NO: 284924 - DNA, 1318 bp, Homo sapiens
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttcaaaacaaaaaaacccgggccttatttccggtcggaaaaagaggttttaaatggccatgcctaagcttttcttgccagtttttccaagggaactgcgggccaatgggcgaaatcgacgtagcccac

SEQ ID NO: 284925 - DNA, 634 bp, Homo sapiens
ttagtagttgtgttgggataagcaggagtctataactttccctcatcaaagatccttctggtctcaagggctctgttctctggtgaaggccatggaggtggacatagaggagaggcctaaagagcttgtacggaagccctatgtgctgaatggtgggtgtggtccatatattcctttaggtcactgtcctgcactgtgggaagctgggaagggccctaagatgtcctcattttgcagatggagaaaccaagtttcagaggggagaagtgagctggttcaaagttcacagagttaggactgtgtcctggctggctcatttttcattgtactgactaaaccctgaccttactgtgtgaactaaggtcagagatgtttagggaggatgtacccaggtgcctgggagaatagaagagaaaccagtaaatctctggcatgggtatggcttctcatgaatttaaggatgaactgatttttagggattccaccatctcaataaatgttccaatgacaaaatcgattttatgtatattaaggctatagagagtgaacgctaaaacggaggagagtaaaccctacaggaaagtgggaatactctagaattcttcattcatccttccccttacctgtcagggag

SEQ ID NO: 284926 - DNA, 1283 bp, Homo sapiens
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttc

SEQ ID NO: 284927 - DNA, 1372 bp, Homo sapiens
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatggtgagggggctggggttccgggtggccgtgggcctcggccgggacggtccgcgagatgacggatccgcgatgtctctctttgccggtagctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttc

SEQ ID NO: 284928 - DNA, 1193 bp, Homo sapiens
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttc

SEQ ID NO: 284929 - DNA, 1559 bp, Homo sapiens
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccggtgggaagtcgacttcccaccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagccgttcccgcctagccagggccatgtcttaggtgcagctgtctcacggtcagctgagccacagtcccagaccaagctccgg

SEQ ID NO: 284930 - DNA, 679 bp, Homo sapiens
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcgggatcgaatgctcccacatccgacatgcctgggaccacgctaaatcggtacggcagaacctgctgttttcagggtgggtgatgtaaatatagtgtgtacataataaagcaaatatattttacttc

SEQ ID NO: 284931 - DNA, 818 bp, Homo sapiens
cataaagtcctgcccttcaagagctgaatgacctccagttttgtgtaatattaaaatgtatcttgaaacttcaggggtgacattttagatggcaagtacagttctctgcatagccccaaaacccatgtatcgaggcaaacaattcatatacattaggattatctttatgtagaaatgtacaattctggaacatagttgtactttattgatttataaatgaggaaaccgaagtaccctctgccctaggagtattttttgggtgtgtacgtattttgtgtgtgtataggcaaggaacaggagaaagtgaggtgaagtcagaatttaacttttctggaagctttcatttcctctaaacctattttttgcttgttgttagacaagtcatgctgctaatatatagcacttagttggctagtatctgagtgtcgctctgggcaaccagattgcacaatgcctcaaattccaataagggaagtccttgttccttagccaacagcttatgggtgtctgtgtgtgtgtatgtgtatgtgtatgtacgtgtatgtgtgtaatttgtgatgactcagtgtctaggaaggtacaaacattgtagctaatctatttctgtttcttacattacctttcaggaatgggcctggaagacctggctaaaacctttgaatcatttcctgccaacatttggccgtgacccattttggaaggtagaaaatggtccttaaagatgatgtcataggatcttggtaaatctgaatattacttcagttttccaagtgccacctcaaagcaatacttaccccagtccagaccatcacacacat

SEQ ID NO: 284932 - DNA, 711 bp, Homo sapiens
agacaatgtctggtgtctggtggtctcctgactgccaggcaggccagagaaaattaggggtatgttttcatttaacatcattccctgctgactcttgtctctctggaaaattgacagttaggagacaaaaacgttgccatctccagcaaagagcgcttgaacagctgggcatttctagaaaggaatgggcctggaagacctggctaaaacctttgaatcatttcctgccaacatttggccgtgacccattttggaaggtcactcagctattggtctgaagaagccttttttttttctatttggccttctttggaagccaatttatcgtctgagttcttctcctgtaatctgaactacaggttgcaggttctgaactacctgaagccatgcaagtcataacacatcattactgacttctagctctttccttcaagtctctggcattgcagatgttatttctgtcctaagaagagcaagaggagctgcaatatgaaaccagaaaacagacacacttcatttctctctgctgttggtgttttctggggagaccagtggagtcactctgggcaggactgagggggacctgggtatatgaccaagccctggacagttcatgtgaaggagcaggacccagcttccaggtcaggagggaaacatgcctgacctttgtgctgctctgccaggtgaggtgtcctttcctctcctcaccca

SEQ ID NO: 284933 - DNA, 808 bp, Homo sapiens
tcactcaggacatttacgtatggggaagaccaccagactcggcaatgactgtaattacgtagaggtgtcatcttgtgaagaggtcagcatggctcctgcctctggtcgtcccatgactaccaaacaccacggcacatctgtatctatattcaagtttccatcgagtgtgagtttctttggctgcatccctctgtgccttctgcaggagtgctgggcacctgctgcagtcgtggacggccctcagatctggctggtgcaagctcccctcctgcaagggttcaagcgccccctccagtctgtctgcttttgacggctctccagtgcttctcacagctgggtttctatattctgtgcagagttcaatttttaactgtggaacggttagtctgataagttcttcctctattactgaaaccaaaattcctctgaagcttgcactttttattctgtggtagttctaattaagaaagcatgctacattttatcattaattttaggatagttccatcacaggcttacataaaggcattgtaaaaactttctaagtgtaagatagtgctactactaagctaactttactaggtttttcttcacaaatttacccaaagtggaatttattccattttcaaatgtctaataaaatgttgaacattgttcaatgagtgttcttgcaatgactagaggctttcctctagactgacatgaagacatgatgggcataagtcagcaactaggactcctgaaatatcaaggaaaaactgtcaaatgacttgcaaaacctaaattcaccatgtatgccatttctcta

SEQ ID NO: 284934 - DNA, 549 bp, Homo sapiens
gaagagctaccctgaccatgcctgctgtggctcattcacattacacaattcaaagttggcaaacgtggtgactaagcaagcaaaaagcttggctaaaaactcacatattcaaatcgatccttgcagagctgaaccatcaggtgcagaaagacaagtccggcaaaccagaggcaccacatgaccacctcttccactgtctggacattcagcacaccaaagatgaaaatgaacttgtagaaaataaaattccaaaatttgtctttgagatgctaaaaaagaaaaatgtttatgaagagatggggcctccctctgttgctaaggctggtcgcaaactcctgggctcaagtgatcccaccttggtctcccaaaagaatgcttttatatgtaatttggaaccatgtaaatgtttcacaaattcaaaaaataaacacaaaaaagcaaaatatactacaaattaacaacgtgactccttaaagattttgagaacttaaacacactgtactctgaccagatatcttttgtagagaacaaaataaagtggaaaaaaat

SEQ ID NO: 284935 - DNA, 1021 bp, Homo sapiens
  misc_feature (2)..(2): n is a, c, g, or t
  misc_feature (32)..(32): n is a, c, g, or t
gnacccccggagggataatgaaggagccattncggaaaatgtttctctcaaagttcgcggaaaaaatgcacattgaggcagaagaagaggtgagtgaggcccttcacgatgttgattttcagcagttgaagatagagaacgctcaatttcttgagacaattgaagcaaggaatcaagaactgacccagctaaagctgtcatctggaaacactctgcaggttctcaatgcctacaaaagcaagcttcacaaggcaatggaaatatacctcaatctggacaaggagatcttgctgagaaaagagctacttgaaaaaattgaaaaagaaacactacaagtagaggaggaccgggccaaagccgaggcagtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgagtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggg

SEQ ID NO: 284936 - DNA, 679 bp, Homo sapiens
ctgcctctagagtatccccggtggtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgagtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggg

SEQ ID NO: 284937 - DNA, 532 bp, Homo sapiens
aaataagcccagtgccttcactgtggtcatggggctgggctgcatttagtgtccatgtccttagattcagatggcaacatggtccagtaacagaagactttttatggaacctttcccaggagacccgattccgtaaggggagcaggtggccctggtcgctggaaggaaaggtgaccacagacccagcgcctcaggaacatcccccgcactcacggctaagcctgtccccagggaaatcctgagaaatggaatttctcctggatcatggtggcagaggggtggctggagctcgtgtcctgtgttcaggacctgctcctgaggctaaacaggttgggagaactttcacctggcagagcctcaagcgcacctggcacccaacatggagcaaacacaaagcatttagaatctcagtgaacacaggcctctgatgcaggaaaccaccaggttccccagttccaccaaggaagacgcatcggttccctgtgaaaacatctgtgactttatgtacgaataaaacttatgtaactttaca

SEQ ID NO: 284938 - DNA, 475 bp, Homo sapiens
cgtacctgcacaggtggtcgctgatgtgctgcaggaccacagggagcagaaggatttggaaggagacccgattccgtaaggggagcaggtggccctggtcgctggaaggaaaggtgaccacagacccagcgcctcaggaacatcccccgcactcacggctaagcctgtccccagggaaatcctgagaaatggaatttctcctggatcatggtggcagaggggtggctggagctcgtgtcctgtgttcaggacctgctcctgaggctaaacaggttgggagaactttcacctggcagagcctcaagcgcacctggcacccaacatggagcaaacacaaagcatttagaatctcagtgaacacaggcctctgatgcaggaaaccaccaggttccccagttccaccaaggaagacgcatcggttccctgtgaaaacatctgtgactttatgtacgaataaaacttatgtaactttaca

SEQ ID NO: 284939 - DNA, 1596 bp, Homo sapiens
  misc_feature (257)..(257): n is a, c, g, or t
agttttattgggctataattcacataccatataattcacccattttgtacaattcaatgattttggcatattattttttaactatggtaaagtacatgttaaataaaatggctcggcattgttttcggaccgagctcctgcgctagggcccaacagagcagcccaaagcggaaccgagtcacgcgcgccggacgccacccgacagaggggaaacggggcagctctcaaaaccctggaggcgcagaccgtccacacgngacagggacgcccgctcggctccgctccgcgctgatcctcaaggtctcgcggtttccccgccgcccacccggacgccgacgaaagccagcgagctcctcagcctcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaaaattaactggaataactcatcaga

SEQ ID NO: 284940 - DNA, 1017 bp, Homo sapiens
cccggaagtggctctcagggcgcttccggggaccaggcccgcttttggctgcatcagccggggattgccggcgccaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaac

SEQ ID NO: 284941 - DNA, 3380 bp, Homo sapiens
cccggaagtggctctcagggcgcttccggggaccaggcccgcttttggctgcatcagccggggattgccggcgccaggtgctgggggcgactcggacagcgggagcgtggggtggagtaggatggagtctccctcccgagctgggggtgtgggcctaggaaaggctgcttcgccgctgtgttcggagagctctggatactgcggggcttttccgcggaggagcgcccgccggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcaagcgatatctgaagtggctctgatgcctttgccacactcctcgcatctctgggacatcccttccgcactctctccctgactttcaagaggctgacaatccaggccgctgcttcccagctccttacatccctggggtgcgtccttggtgaaggtcttgggaaccacagtctcctcattcaaacagttattttggaaggtaaagcctgtcactttcagcccgggactgcccagatgactgtctaaccagacctcagaatcagaaacgtctccaaagccaggattctgaggaaagtcctgtggggagattctgaccactgtcccataggattctgattttaggatgtccatgtcctcacaggcctgctcattttcagtcctaatcgtagaatctgaaataaacaggaacaaagacgttccttaggccctgtgctcagagaaatgataagactacaaatgcgggggccagggctcaaggctcccaggatagttgcactgagcactgtgaggccccaggtggaaacgtgcaagagaaggcagagcctttgacagttctcaaaagtggtttcatactttttaccttgttcactcattcgatagcaatgaatgttcattgctggggcagggctgggttctgtgagcagagaggtccatcctacaggcactggtgtggggcacagtccatgcagaggcaaaggagacaaagcaagaccagaagggtgggaagctaccacggattgggctgcggggtcaggggctccagcatccgagctggcgaggaaacagtacagggtctgagttctgaatggagagcatggattgtgatgaggaaacaaggctggaagagctgccaagggacttactacgtgagctcagaagagcactgggcacctaggccgttcatggctactccctggggtgggcttctctgagcaggacccagccccctcagctgcctcctggctgctgctgccaacttgcacctggccacctcccctgcttctccctgggctgtgcgtggccacctctaagaccacactgacttcttccctggggctgcaagtttctggaggcccccaggaggccttccagacatctgcgttccttctggactctccaagtaagcacaggcttctgtcctactctgtaaccctagagggcacctctgctgaggtcagacatctccttgatgtctgtgatcaaaccatgacaggatgcaaccacaacacacggctatgatcatgacaaccacggtccccaccacgacacaatcacgttcacaaccacaaccacgcagccacaggtttcaccgtgttggccaggatggtctcgatctcctgacctcgtgatccgcccacctcggcctcccaaatcgctagaatggccggcgtgagccaccatgcccggctccacggcccctacttttcacaactttggactgtccaacttgcttcccgaggcccctacaagccggtggcctctgtaggacctggtcctgccctgctgcaggagtgacggtgatgacccagcagcaactgaaagggaggtgaggggcttcctttctgcagctgagatgcacgcagacccatctcccttgtcatgctgggcagcacaccggctaagcaggggagcagagcaccaggccgggcgcctgcccagcaggagctgatgccggaggcagtgggtgccctggttagggctgaggaccccaagataggctgaagtcctaacttgaagcacctcagaatgtgaccttgtttggaaacacagtcgttgcagattaattagtcaccatgaggtcactggggtggcccctaacccaccatgactggtgtccttctaaggagatggccacatgaacacagacacgcagggagaaggcagccgtgtgaaggagtcggagatcagagtgagggacgcatccacaagccaaggaacccaaggactgccagaaaaccaccagctgcccggagaggcaggacaggatccttccctaaagccttcacaggggggcacggccctgcttgctgaccccccggtttcagatttccggcctccacagctgtgagacaataaatttctgttgttttaagcttcctagtctgtggttcattgttatggcagccacaggaaagtaatgcactcctggagcctgagagggtctgaagggagctgcctcagggaatatgcttacccgaggagaggttactgaatgccaaacctaacccttcacttggatccataggtttgtatctttgcttaacgaaagtatgagtaaaattaaaaatagaacaaaatgtgaca

SEQ ID NO: 284942 - DNA, 1096 bp, Homo sapiens
cacaccattctcctgcctcggcctcccgagtagctgggactacaggcgcctgccaccacgcctggttaattttttgtatttttagtagacacagggtttcaccgtgttggccaggatggtctcgatctcctgacctcgtgatccgcccacctcggcctcccaaatcgctagaatggccggcgtgagccaccatgcccggctccacggcccctacttttcacaactttggactgtccaacttgcttcccgaggcccctacaagccggtggcctctgtaggacctggtcctgccctgctgcaggagtgacggtgatgacccagcagcaactgaaagggaggtgaggggcttcctttctgcagctgagatgcacgcagacccatctcccttgtcatgctgggcagcacaccggctaagcaggggagcagagcaccaggccgggcgcctgcccagcaggagctgatgccggaggcagtgggtgccctggttagggctgaggaccccaagataggctgaagtcctaacttgaagcacctcagaatgtgaccttgtttggaaacacagtcgttgcagattaattagtcaccatgaggtcactggggtggcccctaacccaccatgactggtgtccttctaaggagatggccacatgaacacagacacgcagggagaaggcagccgtgtgaaggagtcggagatcagagtgagggacgcatccacaagccaaggaacccaaggactgccagaaaaccaccagctgcccggagaggcaggacaggatccttccctaaagccttcacaggggggcacggccctgcttgctgaccccccggtttcagatttccggcctccacagctgtgagacaataaatttctgttgttttaagcttcctagtctgtggttcattgttatggcagccacaggaaagtaatgcactcctggagcctgagagggtctgaagggagctgcctcagggaatatgcttacccgaggagaggttactgaatgccaaacctaacccttcacttggatccataggtttgtatctttgcttaacgaaagtatgagtaaaattaaaaatagaacaaaatgtgaca

SEQ ID NO: 284943 - DNA, 1469 bp, Homo sapiens
  misc_feature (130)..(130): n is a, c, g, or t
gggcaggcagttgaggtggattaaaccaaacccagctacgcaaaatcttagcatactcctcaattacccacataggatgaataatagcagttctaccgtacaaccctggaggcgcagaccgtccacacgngacagggacgcccgctcggctccgctccgcgctgatcctcaaggtctcgcggtttccccgccgcccacccggacgccgacgaaagccagcgagctcctcagcctcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaaaattaactggaataactcatcaga

SEQ ID NO: 284944 - DNA, 1463 bp, Homo sapiens
cccggaagtggctctcagggcgcttccggggaccaggcccgcttttggctgcatcagccggggattgccggcgccaggtgctgggggcgactcggacagcgggagcgtggggtggagtaggatggagtctccctcccgagctgggggtgtgggcctaggaaaggctgcttcgccgctgtgttcggagagctctggatactgcggggcttttccgcggaggagcgcccgccggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaaaattaactggaataactcatcaga

SEQ ID NO: 284945 - DNA, 1171 bp, Homo sapiens
cccggaagtggctctcagggcgcttccggggaccaggcccgcttttggctgcatcagccggggattgccggcgccaggtgctgggggcgactcggacagcgggagcgtggggtggagtaggatggagtctccctcccgagctgggggtgtgggcctaggaaaggctgcttcgccgctgtgttcggagagctctggatactgcggggcttttccgcggaggagcgcccgccggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaac

SEQ ID NO: 284946 - DNA, 2333 bp, Homo sapiens
cccggaagtggctctcagggcgcttccggggaccaggcccgcttttggctgcatcagccggggattgccggcgccaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcaagcgatatctgaagtggctctgatgcctttgccacactcctcgcatctctgggacatcccttccgcactctctccctgactttcaagaggctgacaatccaggccgctgcttcccagctccttacatccctggggtgcgtccttggtgaaggtcttgggaaccacagtctcctcattcaaacagttattttggaaggtaaagcctgtcactttcagcccgggactgcccagatgactgtctaaccagacctcagaatcagaaacgtctccaaagccaggattctgaggaaagtcctgtggggagattctgaccactgtcccataggattctgattttaggatgtccatgtcctcacaggcctgctcattttcagtcctaatcgtagaatctgaaataaacaggaacaaagacgttccttaggccctgtgctcagagaaatgataagactacaaatgcgggggccagggctcaaggctcccaggatagttgcactgagcactgtgaggccccaggtggaaacgtgcaagagaaggcagagcctttgacagttctcaaaagtggtttcatactttttaccttgttcactcattcgatagcaatgaatgttcattgctggggcagggctgggttctgtgagcagagaggtccatcctacaggcactggtgtggggcacagtccatgcagaggcaaaggagacaaagcaagaccagaagggtgggaagctaccacggattgggctgcggggtcaggggctccagcatccgagctggcgaggaaacagtacagggtctgagttctgaatggagagcatggattgtgatgaggaaacaaggctggaagagctgccaagggacttactacgtgagctcagaagagcactgggcacctaggccgttcatggctactccctggggtgggcttctctgagcaggacccagccccctcagctgcctcctggctgctgctgccaacttgcacctggccacctcccctgcttctccctgggctgtgcgtggccacctctaagaccacactgacttcttccctggggctgcaagtttctggaggcccccaggaggccttccagacatctgcgttccttctggactctccaagtaagcacaggcttctgtcctactctgtaaccctagagggcacctctgctgaggtcagacatctccttgatgtctgtgatcaaaccatgacaggatgcaaccacaacacacggctatgatcatgacaaccacggtccccaccacgacacaatcacgttcacaaccacaaccacgcagccacagctataaccagcccgagtctaccccacatgaatgcacagcccagttacagggcttcaagcttcggttcctgcccactcctaaccattggtggtgagtctccggcttcca

SEQ ID NO: 284947 - DNA, 1581 bp, Homo sapiens
cccggaagtggctctcagggcgcttccggggaccaggcccgcttttggctgcatcagccggggattgccggcgccaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcaagcgatatctgaagtggctctgatgcctttgccacactcctcgcatctctgggacatcccttccgcactctctccctgactttcaagaggctgacaatccaggccgctgcttcccagctccttacatccctggggtgcgtccttggtgaaggtcttgggaaccacagtctcctcattcaaacagttattttggaaggagatggccacatgaacacagacacgcagggagaaggcagccgtgtgaaggagtcggagatcagagtgagggacgcatccacaagccaaggaacccaaggactgccagaaaaccaccagctgcccggagaggcaggacaggatccttccctaaagccttcacaggggggcacggccctgcttgctgaccccccggtttcagatttccggcctccacagctgtgagacaataaatttctgttgttttaagcttcctagtctgtggttcattgttatggcagccacaggaaagtaatgcactcctggagcctgagagggtctgaagggagctgcctcagggaatatgcttacccgaggagaggttactgaatgccaaacctaacccttcacttggatccataggtttgtatctttgcttaacgaaagtatgagtaaaattaaaaatagaacaaaatgtgaca

SEQ ID NO: 284948 - DNA, 1028 bp, Homo sapiens
cccggaagtggctctcagggcgcttccggggaccaggcccgcttttggctgcatcagccggggattgccggcgccaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttttttcttttttttttttttttttttttttttttttttt

SEQ ID NO: 284949 - DNA, 1394 bp, Homo sapiens
cccggaagtggctctcagggcgcttccggggaccaggcccgcttttggctgcatcagccggggattgccggcgccaggtgctgggggcgactcggacagcgggagcgtggggtggagtaggatggagtctccctcccgagctgggggtgtgggcctaggaaaggctgcttcgccgctgtgttcggagagctctggatactgcggggcttttccgcggaggagcgcccgccggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcatacgcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaaaattaactggaataactcatcaga

SEQ ID NO: 284950 - DNA, 1545 bp, Homo sapiens
  misc_feature (257)..(257): n is a, c, g, or t
agttttattgggctataattcacataccatataattcacccattttgtacaattcaatgattttggcatattattttttaactatggtaaagtacatgttaaataaaatggctcggcattgttttcggaccgagctcctgcgctagggcccaacagagcagcccaaagcggaaccgagtcacgcgcgccggacgccacccgacagaggggaaacggggcagctctcaaaaccctggaggcgcagaccgtccacacgngacagggacgcccgctcggctccgctccgcgctgatcctcaaggtctcgcggtttccccgccgcccacccggacgccgacgaaagccagcgagctcctcagcctcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctcccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaaaattaactggaataactcatcaga

SEQ ID NO: 284951 - DNA, 1148 bp, Homo sapiens
  misc_feature (257)..(257): n is a, c, g, or t
agttttattgggctataattcacataccatataattcacccattttgtacaattcaatgattttggcatattattttttaactatggtaaagtacatgttaaataaaatggctcggcattgttttcggaccgagctcctgcgctagggcccaacagagcagcccaaagcggaaccgagtcacgcgcgccggacgccacccgacagaggggaaacggggcagctctcaaaaccctggaggcgcagaccgtccacacgngacagggacgcccgctcggctccgctccgcgctgatcctcaaggtctcgcggtttccccgccgcccacccggacgccgacgaaagccagcgagctcctcagcctcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaaaattaactggaataactcatcaga

SEQ ID NO: 284952 - DNA, 1286 bp, Homo sapiens
  misc_feature (257)..(257): n is a, c, g, or t
agttttattgggctataattcacataccatataattcacccattttgtacaattcaatgattttggcatattattttttaactatggtaaagtacatgttaaataaaatggctcggcattgttttcggaccgagctcctgcgctagggcccaacagagcagcccaaagcggaaccgagtcacgcgcgccggacgccacccgacagaggggaaacggggcagctctcaaaaccctggaggcgcagaccgtccacacgngacagggacgcccgctcggctccgctccgcgctgatcctcaaggtctcgcggtttccccgccgcccacccggacgccgacgaaagccagcgagctcctcagcctcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatgacaggcataagccaccacactcggcctgaagttggatattcttgagagcaattctgaacctttaccaacattctacatgtttgtcagtataaacgattccatataaaataagtaagttaaggctataggtttattcacatatatacacatttatatgtaagtggtctatcccatgtgaattttttgatgctgggtaagccttgagctacgattaaaagctttgccacagtca

SEQ ID NO: 284953 - DNA, 446 bp, Homo sapiens
gagctgcatgctgggtgcgggaagaggtgggcgagaagcaaaagaaggaagattgggagcgcatggtttagggtggggtggagtggaagggcaaatggggaccatactagactgcagaactaactaaaagggcacggactcagcgactccgcgacggagcctgcctgggtgagggagtctctgggacgcagggggctcctgtagctggcaggttgctgggcaggagggggtcacaaacacggcagggaagtctcgtcgctgcgaaggggacgcggcatccatctctcctcgggaactttgaaaatgctcagttcttctggcctagtctccgctggggccgccgcccgcgcctccccgggccaccccagctccgccaggccccccagggcccgggcccttccggccgcgctctccgctctttatcttcttccgcgccatgtggcccc

SEQ ID NO: 284954 - DNA, 472 bp, Homo sapiens
tttcagtaccaggattctttgggcggtgagtgccagagggccccagtcacccagaacccccaccccgagtcaaagcgctgaaatgagccccgcggcagctttgaaaatgctcagttcttcttcggtccagggcggggcagaagggaggatgcagagggagaaacaggatgaactcaaacacaggagataggagatgatttggatgaagtgataaagaaaaggcttcactccaagaaaaaaaagaaaaagaaaagaaaatgaaaagacctgcaggagcaagaagccctttccagggtgtgcttatgaggaagaagggaattatggtgatagctaccacttaagcacttaccttgttccaggtgcaataacggtgttttacaggcattattttatttagtcccccaaaataaagctattacgtacctttttatcattacccctaataaaactaatgattagactgtttaaaaac

SEQ ID NO: 284955 - DNA, 353 bp, Homo sapiens
gcccagagattgttttcccattgactcttcattttccactgcccaaggatgaactcaaacacaggagataggagatgatttggatgaagtgataaagaaaaggcttcactccaagaaaaaaaagaaaaagaaaagaaaatgaaaagacctgcaggagcaagaagccctttccagggtgtgcttatgaggaagaagggaattatggtgatagctaccacttaagcacttaccttgttccaggtgcaataacggtgttttacaggcattattttatttagtcccccaaaataaagctattacgtacctttttatcattacccctaataaaactaatgattagactgtttaaaaac

SEQ ID NO: 284956 - DNA, 491 bp, Homo sapiens
ccggctgggaggggtgagggtgggcagagggaagggctggggattcgatccttttctcccactcacgggtcccaccccgccgcctaggggccgtgctttgaaaatgctcagttcttcttcggtccagggcggggcagaagggaggatgcagagggagaaacaggtgagctcctggaatccgcgcaaccttcagcctcttcccacccacctcccatctcggatttctatcccccaacccttagctccctccacgccccctgcacctccaacccgcccttattctccccctgctcctggggagggctggggaagggcagctgtcagccagccgcgcgccgcccgcctcacctggcctagtctccgctggggccgccgcccgcgcctccccgggccaccccagctccgccaggccccccagggcccgggcccttccggccgcgctctccgctctttatcttcttccgcgccatgtggccccgaaaactcgcctg

SEQ ID NO: 284957 - DNA, 1145 bp, Homo sapiens
agctggggcatttcaatcctgtatgtgagagctagagactcatacagtgacctagagcaggcatgggtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgataaaaatggcgtgca

SEQ ID NO: 284958 - DNA, 945 bp, Homo sapiens
agctggggcatttcaatcctgtatgtgagagctagagactcatacagtgacctagagcaggcatggaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgataaaaatggcgtgca

SEQ ID NO: 284959 - DNA, 1171 bp, Homo sapiens
agctggggcatttcaatcctgtatgtgagagctagagactcatacagtgacctagagcaggcatgggtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcgtaagtgaaggacagtttgcaaccttaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgataaaaatggcgtgca

SEQ ID NO: 284960 - DNA, 1049 bp, Homo sapiens
agctggggcatttcaatcctgtatgtgagagctagagactcatacagtgacctagagcaggcatggaattttgggtgtcaccaggtaaacagagccctcagcatctgaatagaaactgaacaggaacagttagacacaacagcagaaactcccaggaaacaaacacgatttcacttttagctctgcaacaaagtggaatcttcctctacaggatcaacttgccgaaggaactgaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgataaaaatggcgtgca

SEQ ID NO: 284961 - DNA, 1157 bp, Homo sapiens
agccccgtgccaggcaaggcgggtcaccgggcagcgtcggggccctcttctgcctcggggtctcttcacggagggcgccctgcggcgacagctttcgccggccgcgcgcacggcggtcggtacctgttaaggacgagatgccttccgaccaccggataactcgggacggtccctgatttgcctgctccctgtccaacagcatcttcggctcactcggaagtgaaaacatgcaatttcatgttataacatgcaatttcatgtcataaattattcccactgacgcctgaacatttttcctaaaagggatctgcagtcacaaggcgccgccttccggaatttagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgataaaaatggcgtgca

SEQ ID NO: 284962 - DNA, 1036 bp, Homo sapiens
agctggggcatttcaatcctgtatgtgagagctagagactcatacagtgacctagagcaggcatgggtgggtcacaggctttggagagcactctctgtcctgatcttttcagttgagagacttcagctgttcattgctcatttggacttagttcaagaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgataaaaatggcgtgca

SEQ ID NO: 284963 - DNA, 1873 bp, Homo sapiens
ccaaatggcttcttctcccacagacaattgctgccactgtctctggattagaaaccacttgacagaggggacagcccggctaagggccctgcatggtcaggtgaagagatctttaggagtcagtgttgaaggcagaaaacgcccccagaggttcccctcatcccccgttgcagcctgtgtgtctaagcgcttggccagagccagagagtcgccggcaagggaaactccgcggcgagcacgcagcagcagaagggttaacgcgccgggctccgcctcccaaccgcctcttccgggcagagaggcgggcttacgtcacttcctggagactggttgaatccggaagtgaccctagagaaacgagttgtggctgaggaccccggcggcagacgcaggttcgggaccatgagctggattccttttaagattgggcagcccaagaaacagattgtgcccaaaacagtggagagagactttgaaagggagtatggaaaacttcagcagctggaagagcagacccggaggctgcagaaagacatgaagaagagcaccgacgcagacctggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtc

SEQ ID NO: 284964 - DNA, 2150 bp, Homo sapiens
ccaaatggcttcttctcccacagacaattgctgccactgtctctggattagaaaccacttgacagaggggacagcccggctaagggccctgcatggtcaggtgaagagatctttaggagtcagtgttgaaggcagaaaacgcccccagaggttcccctcatcccccgttgcagcctgtgtgtctaagcgcttggccagagccagagagtcgccggcaagggaaactccgcggcgagcacgcagcagcagaagggttaacgcgccgggctccgcctcccaaccgcctcttccgggcagagaggcgggcttacgtcacttcctggagactggttgaatccggaagtgaccctagagaaacgagttgtggctgaggaccccggcggcagacgcaggttcgggaccatgagctggattccttttaagattgggcagcccaagaaacagattgtgcccaaaacagtggagagagactttgaaagggagtatggaaaacttcagcagctggaagagcagacccggaggctgcagaaagacatgaagaagagcaccgacgcagacctggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtccacatagtattgtgctgtaacttaggcgagcagaggaaaccccttcctgggcctgctgccctccacggagcagcagcaccctccagcaggcagcccagcatgccaggggtgtgtgcgcacctccccggccctggcccaccttctggagcgaactgcaccgtggtccagcagaggcgctgggtgggagggcacgcgggcaagcctaggagagtaggaagagctgtggaggacacactctcagtttgtttttgactttggtttatttaaaaaacaagcc

SEQ ID NO: 284965 - DNA, 2047 bp, Homo sapiens
ccaaatggcttcttctcccacagacaattgctgccactgtctctggattagaaaccacttgacagaggggacagcccggctaagggccctgcatggtcaggtgaagagatctttaggagtcagtgttgaaggcagaaaacgcccccagaggttcccctcatcccccgttgcagcctgtgtgtctaagcgcttggccagagccagagagtcgccggcaagggaaactccgcggcgagcacgcagcagcagaagggttaacgcgccgggctccgcctcccaaccgcctcttccgggcagagaggcgggcttacgtcacttcctggagactggttgaatccggaagtgaccctagagaaacgagttgtggctgaggaccccggcggcagacgcaggttcgggaccatgagctggattccttttaagattgggcagcccaagaaacagattgtgcccaaaacaccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtccacatagtattgtgctgtaacttaggcgagcagaggaaaccccttcctgggcctgctgccctccacggagcagcagcaccctccagcaggcagcccagcatgccaggggtgtgtgcgcacctccccggccctggcccaccttctggagcgaactgcaccgtggtccagcagaggcgctgggtgggagggcacgcgggcaagcctaggagagtaggaagagctgtggaggacacactctcagtttgtttttgactttggtttatttaaaaaacaagcc

SEQ ID NO: 284966 - DNA, 1181 bp, Homo sapiens
ccaaatggcttcttctcccacagacaattgctgccactgtctctggattagaaaccacttgacagaggggacagcccggctaagggccctgcatggtcaggtgaagagatctttaggagtcagtgttgaaggcagaaaacgcccccagaggttcccctcatcccccgttgcagcctgtgtgtctaagcgcttggccagagccagagagtcgccggcaagggaaactccgcggcgagcacgcagcagcagaagggttaacgcgccgggctccgcctcccaaccgcctcttccgggcagagaggcgggcttacgtcacttcctggagactggttgaatccggaagtgaccctagagaaacgagttgtggctgaggaccccggcggcagacgcaggttcgggaccatgagctggattccttttaagattgggcagcccaagaaacagattgtgcccaaaacagtggagagagactttgaaagggagtatggaaaacttcagcagctggaagagcagacccggaggctgcagaaagacatgaagaagagcaccgacgcagacctggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggaggaagccacagggtgccaggctcccgcgtgtccaggttggagcagatgggaggccagggatgccctttaaccaggcagcattgctgggggctgttgactgcctcttgggccccagcctccccctcgcccgcccggctgccattagtcatggagaagtgagta

SEQ ID NO: 284967 - DNA, 1376 bp, Homo sapiens
ccaaatggcttcttctcccacagacaattgctgccactgtctctggattagaaaccacttgacagaggggacagcccggctaagggccctgcatggtcaggtgaagagatctttaggagtcagtgttgaaggcagaaaacgcccccagaggttcccctcatcccccgttgcagcctgtgtgtctaagcgcttggccagagccagagagtcgccggcaagggaaactccgcggcgagcacgcagcagcagaagggttaacgcgccgggctccgcctcccaaccgcctcttccgggcagagaggcgggcttacgtcacttcctggagactggttgaatccggaagtgaccctagagaaacgagttgtggctgaggaccccggcggcagacgcaggttcgggaccatgagctggattccttttaagattgggcagcccaagaaacagattgtgcccaaaacagtggagagagactttgaaagggagtatggaaaacttcagcagctggaagagcagacccggaggctgcagaaagacatgaagaagagcaccgacgcagacctggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagaggaaccaactcttctggtcctgggtcacctccgaatggccacagagtcatgagctccctgggctgcgcagcctgatcctggacactgcagggctctggcttgcctggtagacgccccctgccattgcaccgagggccagccctccagcagcagcagcgagagcctcaggagagcactgctcctggtcactagaggacacatgatccacaaagacgaggccggtgtggacctgcagcgttgcatcgtccactgctgctctctctgagggccactcctctgagtctcccacgcggtcccttctagtcacagtggaggtcctcagggcattttcctgaagcagctggttggaactttggcggttccaatggcagagccagaggatttctgctgctttcatgttgccaaggagcccttgaaggagaaggtgccctggggcaggggtgagtttagatttcagttctgccacctgccagtggcactgtgagggctggaaagggtgccagacagagaatgtggacacctgtgttctcttctagaccttctctgcctcatcgtgactttggatgagtcataggtcatctctctctgtcctcagtttccctcctttttaaaagtgaggtgttggccagatgac

SEQ ID NO: 284968 - DNA, 852 bp, Homo sapiens
ccaaatggcttcttctcccacagacaattgctgccactgtctctggattagaaaccacttgacagaggggacagcccggctaagggccctgcatggtcaggtgaagagatctttaggagtcagtgttgaaggcagaaaacgcccccagaggttcccctcatcccccgttgcagcctgtgtgtctaagcgcttggccagagccagagagtcgccggcaagggaaactccgcggcgagcacgcagcagcagaagggttaacgcgccgggctccgcctcccaaccgcctcttccgggcagagaggcgggcttacgtcacttcctggagactggttgaatccggaagtgaccctagagaaacgagttgtggctgaggaccccggcggcagacgcaggttcgggaccatgagctggtgagtgaggcccaggcggcgggagctgctggacccgcggacccgcgaggcccctggccctgtgtcagtgccgcgtcccggctccctccggtcccgcgcgacccctccgccccagagcaaggcccgacagcccctgccctagggtcgttccctcggtgctttccggagtcgcagtctctcagcaggactcccggggagagtggcggatgatcctcttagcctgggactccgcgtctgacccgttttgccggactcgcgtcctcctagctccttgaagtgagggacttccttgttccctccttttttaaacacccattgaggtggagtcagtgtcgtctttctctcctgtgggcatctctgccccgcgccagtccctccagagctgtggccctcgctgtggcagcctggacccagttcactaatcaaaacccactcccttctg

SEQ ID NO: 284969 - DNA, 411 bp, Homo sapiens
cggcctcgtctttgtggatcatgtgtcctctagtgaccaggagcagtgctcctctgagtctcccacgcggtcccttctagtcacagtggaggtcctcagggcattttcctgaagcagctggttggaactttggcggttccaatggcagagccagaggatttctgctgctttcatgttgccaaggagcccttgaaggagaaggtgccctggggcaggggtgagtttagatttcagttctgccacctgccagtggcactgtgagggctggaaagggtgccagacagagaatgtggacacctgtgttctcttctagaccttctctgcctcatcgtgactttggatgagtcataggtcatctctctctgtcctcagtttccctcctttttaaaagtgaggtgttggccagatgac

SEQ ID NO: 284970 - DNA, 1811 bp, Homo sapiens
ccaaatggcttcttctcccacagacaattgctgccactgtctctggattagaaaccacttgacagaggggacagcccggctaagggccctgcatggtcaggtgaagagatctttaggagtcagtgttgaaggcagaaaacgcccccagaggttcccctcatcccccgttgcagcctgtgtgtctaagcgcttggccagagccagagagtcgccggcaagggaaactccgcggcgagcacgcagcagcagaagggttaacgcgccgggctccgcctcccaaccgcctcttccgggcagagaggcgggcttacgtcacttcctggagactggttgaatccggaagtgaccctagagaaacgagttgtggctgaggaccccggcggcagacgcaggttcgggaccatgagctggattccttttaagattgggcagcccaagaaacagattgtgcccaaaacagtggagagagactttgaaagggagtatggaaaacttcagcaccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtc

SEQ ID NO: 284971 - DNA, 1824 bp, Homo sapiens
ccaaatggcttcttctcccacagacaattgctgccactgtctctggattagaaaccacttgacagaggggacagcccggctaagggccctgcatggtcaggtgaagagatctttaggagtcagtgttgaaggcagaaaacgcccccagaggttcccctcatcccccgttgcagcctgtgtgtctaagcgcttggccagagccagagagtcgccggcaagggaaactccgcggcgagcacgcagcagcagaagggttaacgcgccgggctccgcctcccaaccgcctcttccgggcagagaggcgggcttacgtcacttcctggagactggttgaatccggaagtgaccctagagaaacgagttgtggctgaggaccccggcggcagacgcaggttcgggaccatgagctggtggagagagactttgaaagggagtatggaaaacttcagcagctggaagagcagacccggaggctgcagaaagacatgaagaagagcaccgacgcagacctggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtc

SEQ ID NO: 284972 - DNA, 1721 bp, Homo sapiens
ccaaatggcttcttctcccacagacaattgctgccactgtctctggattagaaaccacttgacagaggggacagcccggctaagggccctgcatggtcaggtgaagagatctttaggagtcagtgttgaaggcagaaaacgcccccagaggttcccctcatcccccgttgcagcctgtgtgtctaagcgcttggccagagccagagagtcgccggcaagggaaactccgcggcgagcacgcagcagcagaagggttaacgcgccgggctccgcctcccaaccgcctcttccgggcagagaggcgggcttacgtcacttcctggagactggttgaatccggaagtgaccctagagaaacgagttgtggctgaggaccccggcggcagacgcaggttcgggaccatgagctgccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtc

SEQ ID NO: 284973 - DNA, 998 bp, Homo sapiens
ctgcttcacataactttgcttggccacactttccacatgtagggcttctgagatccttgcttatttgatttttcaggtgaaaagaggaagttatagggggccaggtgactaatccccaggcattaggctttcaggatgttgaaagattaatcttcattttctcttgggattcaggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284974 - DNA, 1008 bp, Homo sapiens
agaagcaggatttgaaccaggctgacttacaggatgtcatgacacctttgcctctgtcagggatgtgcctgtgtaagatagtcatttccctgattccttcgttggctaggtcttgagtacttgggggacatagcctagtgcagagcagagtcctgggctgagagtcaagcatgatggtgtctaagcctcaattatgtcattcactgggtaacttccagctggttctctaagcatgttgcttacttggatgataagggaagcatgcctagaggtcccctaaggagattggtcaggttatagactgagacccaaggacaggatttcgcatccatgttcatggacaggacagcacctaagtcccccagtgccaccatatttacagcattttagagtcaggaacagagggctaagtagaccaagagcattggctgcctttcagacatccatctatattctaaagggattgagttatttggggttagggtacagagatgggcaggatataaatagatgtcgccaacgtttctggatctccaagacctgtatcagaatcacctgaggcacctgttcagcttgcagattcttgccaatactttgccccaccccaggtgagaatctctggaattgagattcccaggtgcatttggtgtacagtgacagtttgagagtcaccgaaatggggaaggagagactgttgactggtgtgaaaagtgttgctggggccccttctgaggggcttatcttgccatttcttcatgtcctcttgcacctgctcacttcacttctgcattatatctccaaggcgttggtatatggaaaaagatgtaggggcttggaggtgttctggacagtggggagggctccagacccaacctggtcacaaaagagcctctcccccatgcatactcatccacctccctcccctagagctattctcctttgggtttcttgctgctgcaattttatacaaccattatttaaatattattaaacacatattgttctcta

SEQ ID NO: 284975 - DNA, 2277 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284976 - DNA, 2697 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaagtgtgaatggcgttagggtaagggcacagccaggctggagtcagtgtctgcccctgaggtcttttaagttgagggctgggaatgaaacctatagcctttgtgctgttctgccttgcctgtgagctatgtcactcccctcccactcctgaccatattccagacacctgccctaatcctcagcctgctcacttcacttctgcattatatctccaaggcgttggtatatggaaaaagatgtaggggcttggaggtgttctggacagtggggagggctccagacccaacctggtcacaaaagagcctctcccccatgcatactcatccacctccctcccctagagctattctcctttgggtttcttgctgctgcaattttatacaaccattatttaaatattattaaacacatattgttctcta

SEQ ID NO: 284977 - DNA, 3289 bp, Homo sapiens
  misc_feature (2801)..(2801): n is a, c, g, or t
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaagtgtgaatggcgttagggtaagggcacagccaggctggagtcagtgtctgcccctgaggtcttttaagttgagggctgggaatgaaacctatagcctttgtgctgttctgccttgcctgtgagctatgtcactcccctcccactcctgaccatattccagacacctgccctaatcctcagcctgctcacttcacttctgcattatatctccaaggcgttggtatatggaaaaagatgtaggggcttggaggtgttctggacagtggggagggctccagacccaacctggtcacaaaagagcctctcccccatgcatactcatccacctccctcccctagagctattctcctttgggtttcttgctgctgcaattttatacaaccattatttaaatattattaaacacatattgttctctaaaaactgtggtagtgggtttttttgttgtttttgtttttgagactgtctcaaaaactctgtcgcccaggctgacagtgcagtggcacaatcttggctcactgcngcctctgcctcctgggttcaagcgattctcgtgcatcagcctcctgagtaactggaattaataggcacgtgccaccatgtccatctaattcatatatatatattttttttttctgagacggagtctcactgtcactctggcttgggagacagagtgagactccgtctcaaaaaaaagaaaaaaagaaaaacatgtacaacatggaatagagttgatatccagccagtatacactttgagtgatctcattcacactcagtgtatcttcagctaccctcatatgaagtcacagactcacacctgtatttccagcactttgggaggccaaggcagtaggatcactacagcctgagttcagggctgcagtgatctatgattgcagcattgcactggagcctggccaacagagtgagaccctatctcttaaaaattaaaaaataaaaataagtcattataaaagtgtaattatcaagacagttggtattggtg

SEQ ID NO: 284978 - DNA, 2962 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccgtatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaatctggcacatgccccttttcctccagggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284979 - DNA, 2574 bp, Homo sapiens
  misc_feature (2472)..(2472): n is a, c, g, or t
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaaaaaaaaaaaaaaaaaaaaaaaacgggggaaaaaggggggggcgcacaaacagaggggtactaaactgcgagcagtgtggtcatctgcggttcctctgtacccagctttctgctccccgcggagattcgcgggccccccaaaagggggggcgataatcgagatacgccggtacctcgtgattttctctcagaaaangccgcacagaacgcaacacacaatagacgacacctagttggaacaccacggcaagcaacaacaactcgctacaaacttccccatacagtacagtagtgcctg

SEQ ID NO: 284980 - DNA, 2835 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccgtatctttgagagaggaagagagtgggattgctacccacattttaatgaaggtggagctgagccgtagaactctctgggagccatccaacctggctgtggctcataacaaggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284981 - DNA, 2093 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284982 - DNA, 2896 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccgtatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaatctggcacatgccccttttcctccagggcccagagcaggggctgttgccgaaaggctgtggagcaacaagttgacatctgacctgacatttgcctatgaacgtttgtcacacttccgctgtgagttgctgagggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataacaacta

SEQ ID NO: 284983 - DNA, 2186 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284984 - DNA, 2211 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgagggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataacaacta

SEQ ID NO: 284985 - DNA, 1834 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcggtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284986 - DNA, 2769 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccgtatctttgagagaggaagagagtgggattgctacccacattttaatgaaggtggagctgagccgtagaactctctgggagccatccaacctggctgtggctcataacaaggcccagagcaggggctgttgccgaaaggctgtggagcaacaagttgacatctgacctgacatttgcctatgaacgtttgtcacacttccgctgtgagttgctgagggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataacaacta

SEQ ID NO: 284987 - DNA, 3034 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccgtatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaatctggcacatgccccttttcctccagggcccagagcaggggctgttgccgaaaggctgtggaccatcgttgcaacgatggtcctcagctggggtaatggatgtataacacctctctgcactgtttatgagtctataattaaaaagcagggccttggcaacagagttgtgttgaatcccccattaccccagctgagaggtgactttttcctcctggcatttaacgtaattcttaactacctatttgctctgtgcctttctcccccaggagaaagcagaagctgagtctgttttgttcactgctaaattctctgtctcctaacacagtgtgtggcacctgtgttttgaagtcagatgtttgggtgaaagaatagttatggacacaggtgacttaaattctctcaggcggtctgcagttaggtcatacctccctgtcaggacgatgggagaattaaatgtgtataatgtagctaaactgagaccatcgttg

SEQ ID NO: 284988 - DNA, 2773 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccgtatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaatctggcacatgccccttttcctccagggcccagagcaggggctgttgccgaaaggctgtggagcaacaagttgacatctgacctgacatttgcctatgaacgtttgtcacacttccgctgtgagttgctgaggctgcaagggagacgaatgtgtctgaggctcaggggtaagaaagtggttaaagacaccgaagacagagatgtgtgatggggcggggtgggattgg

SEQ ID NO: 284989 - DNA, 2067 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284990 - DNA, 1724 bp, Homo sapiens
  misc_feature (1619)..(1619): n is a, c, g, or t
  misc_feature (1623)..(1623): n is a, c, g, or t
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaaggattcnggcnaccatctacgggtgggaggattccggacaattaggagggaggccagcgcgtcggccttttgcccggagaaggaacaagcgaggggaaaaaccccatgcccc

SEQ ID NO: 284991 - DNA, 1796 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccaggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284992 - DNA, 2230 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgagttctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284993 - DNA, 1954 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgagggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataacaacta

SEQ ID NO: 284994 - DNA, 2297 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattgcatccctgttccctttgccaggagaagacttctttcatctttctgctgtggaaactgacccatgagataccctgaccataaatgatgaccagtgtttactcctctctgagactgtctggggagctctccgagttctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284995 - DNA, 1274 bp, Homo sapiens
ggacgcgtgggtccgacccacgcgttccgctctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284996 - DNA, 1235 bp, Homo sapiens
gacttagaggatccccgcaaactggattcactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284997 - DNA, 1705 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagcccgcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284998 - DNA, 1724 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggattcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 284999 - DNA, 991 bp, Homo sapiens
ggctagagggccggggtgaatcggcgaggatctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 285000 - DNA, 1586 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgagctggagacttttagccagcaggaggtgtttgataataaagtaaattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 285001 - DNA, 1637 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 285002 - DNA, 1253 bp, Homo sapiens
tacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctcctacctacctacctacctacctacctacctccaacctacctaccttaaaacctaatacccctaactggaaggatttctacgtagtggaacccctggcatttgaagtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 285003 - DNA, 1677 bp, Homo sapiens
  misc_feature (1572)..(1572): n is a, c, g, or t
  misc_feature (1576)..(1576): n is a, c, g, or t
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgagttctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaaggattcnggcnaccatctacgggtgggaggattccggacaattaggagggaggccagcgcgtcggccttttgcccggagaaggaacaagcgaggggaaaaaccccatgcccc

SEQ ID NO: 285004 - DNA, 1141 bp, Homo sapiens
tttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaa

SEQ ID NO: 285005 - DNA, 2064 bp, Homo sapiens
  misc_feature (1576)..(1576): n is a, c, g, or t
agaagcaggatttgaaccaggctgacttacaggatgtcatgacacctttgcctctgtcagggatgtgcctgtgtaagatagtcatttccctgattccttcgttggctaggtcttgagtacttgggggacatagcctagtgcagagcagagtcctgggctgagagtcaagcatgatggtgtctaagcctcaattatgtcattcactgggtaacttccagctggttctctaagcatgttgcttacttggatgataagggaagcatgcctagaggtcccctaaggagattggtcaggttatagactgagacccaaggacaggatttcgcatccatgttcatggacaggacagcacctaagtcccccagtgccaccatatttacagcattttagagtcaggaacagagggctaagtagaccaagagcattggctgcctttcagacatccatctatattctaaagggattgagttatttggggttagggtacagagatgggcaggatataaatagatgtcgccaacgtttctggatctccaagacctgtatcagaatcacctgaggcacctgttcagcttgcagattcttgccaatactttgccccaccccaggtgagaatctctggaattgagattcccaggtgcatttggtgtacagtgacagtttgagagtcaccgaaatggggaaggagagactgttgactggtgtgaaaagtgttgctggggccccttctgaggggcttatcttgccatttcttcatgtcctcttgcagcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaagtgtgaatggcgttagggtaagggcacagccaggctggagtcagtgtctgcccctgaggtcttttaagttgagggctgggaatgaaacctatagcctttgtgctgttctgccttgcctgtgagctatgtcactcccctcccactcctgaccatattccagacacctgccctaatcctcagcctgctcacttcacttctgcattatatctccaaggcgttggtatatggaaaaagatgtaggggcttggaggtgttctggacagtggggagggctccagacccaacctggtcacaaaagagcctctcccccatgcatactcatccacctccctcccctagagctattctcctttgggtttcttgctgctgcaattttatacaaccattatttaaatattattaaacacatattgttctctaaaaactgtggtagtgggtttttttgttgtttttgtttttgagactgtctcaaaaactctgtcgcccaggctgacagtgcagtggcacaatcttggctcactgcngcctctgcctcctgggttcaagcgattctcgtgcatcagcctcctgagtaactggaattaataggcacgtgccaccatgtccatctaattcatatatatatattttttttttctgagacggagtctcactgtcactctggcttgggagacagagtgagactccgtctcaaaaaaaagaaaaaaagaaaaacatgtacaacatggaatagagttgatatccagccagtatacactttgagtgatctcattcacactcagtgtatcttcagctaccctcatatgaagtcacagactcacacctgtatttccagcactttgggaggccaaggcagtaggatcactacagcctgagttcagggctgcagtgatctatgattgcagcattgcactggagcctggccaacagagtgagaccctatctcttaaaaattaaaaaataaaaataagtcattataaaagtgtaattatcaagacagttggtattggtg

SEQ ID NO: 285006 - DNA, 318 bp, Homo sapiens
tttcagcccaggggaaagacactgcttaatgaggaataggcccctggccaggctcaacccctagagcactggcacaaacagtctagaacccatctgagctaagcagacacttactagacactcctctcctctccaggctgctggacatcgtctcttcttatggcaagggctatgtggtgtggcaggaggtgtttgataataaagtaaagggtgagccggggcagagaagagaagaagccaccagcagtgcctccctctggtctccccagctcctccctgcctctacagagactgatcctcctggtttggattgggctt

SEQ ID NO: 285007 - DNA, 743 bp, Homo sapiens
atttcaagaagaggaaagaccacttctatcatccatctttggatgtgttctgggaaaagtagaagtgtgctgggccttccctccatgccatccctccctgatgggaaggtttgatagaccccataaatacttaattgagagctgaggcaggtcaagcctgtaggggtgtgtggagcggcctgagagctcgcccaacatcgcaagtttgaggctgaaaccggagagactgtgatgggttcacagtgtgcactttaacctacaggatgtcatggcgtacaataaattgaacgtgttccactggcatctggtagatgatccttccttcccatatgagagcttcacttttccagagctcatgagaaaggtatgttcccgtttcactcagaccaagtttatgggtcaatgtctgaatctggctgtggccctgctggcaagaacagggtctctcatcctaaccagccagttttagaccaatataggggaaggacactggatttggagtcaggagacttgagttcaagtccaaaactttgccgataatttgccttgtgaccttcaggagagaatctcttctggccttattccctttttatgtatttatattctgttaaatggacatagtattaatacctaccatgattatctcactggcattatgatactcagataaaacagatgtgataacttctgggaaattatgatcaagttttttgaagatagtccctgacaccaaagggctatgg

SEQ ID NO: 285008 - DNA, 1388 bp, Homo sapiens
ggtttgctttccatatctgatctttaatccacctggaactgattcgtgtacagtgacagagagggatattggaggctttttccccaacaggagtaactaattgtcccagcaatatattttcatctctgatttttacagtatctctgggtatatcccattttccaaatatgtgtgaaatctgtttctgagctttctaccctgttccattagtctacttatatttttaaccataaacatgtattataacagaaagtttatgtggaaaaggatataaagggatggtgaaggagggaaaagggatggatgtgtagcccatctcaggaaacttaaattcttgaatgtcacagagactagttcagagcaattagttctacaaagaaagaactctatgagcaagttaaaagtaagacagaattaaaaagcagtcacaaattactagggggacaaaggatttgagatataaatcaaattttacacgtaagtgctaaagtatagcatactctttatatatgtaccaagatattttgctcttgctattgttttttaaccatcccctgccagaaacatatacacagatacacaaccacagtaagaaaccattcttaggatatgggttaaatgggatttaaaaaacaataataaaaatgaatttttatgaacttccactgaagttcttcacaaactgtcttaatttagacaaacttcacaaactgtcttaatttagacaattacatgctcatgcatgctatttcctacccttgtgaacttggagcacatttcctctgcttcttttatcatatttgctcgaagcatgtattttgcacatttggaattgatgaatctatcagctgtgtccaaagactgtgcttcatccatccactttgcagcttctttgagattacctatatgctataaaagataattaaaggaaccacaatttataatcaagagaatatgagtacaataaaatggaaaataatttacacagacaaaaaagaaatctgtcaccatttctgtcaaatttatttagaaatcaaaattacagttcacatttactaagagctcaaatgattacacatctaattacacattgattatacaattaatataacatgaaactacacaggattattagaaaaagattatcagggtgccctagaacttgtttccacaaagaaaaaactccaaggattcttaaagtagctgaattcttcaactactcaaaaaacaggattcagattttaccttgtaaatttttgctttcatatagaataattctattagagttggagtactagcaattgcagcattaatataatccaaagccaaagaatactgtccaagtttatcaaagtgctgtgccagtaaatataaacccattatgttat

SEQ ID NO: 285009 - DNA, 355 bp, Homo sapiens
ttttgaatataataataattttaatgcattttacagtgtgcctttatcccataagttgaaaaaaacatccttatgactttgttactgtttttctttctcttctctttgcagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcac

SEQ ID NO: 285010 - DNA, 2930 bp, Homo sapiens
gatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcaccgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagatgggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagagggtggggaatatgaattccgagtcaaagctgtcaatgctgcaggagtcagcaagccttcagccactgttggccctgtgactgtcaaagaccagacatgcccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagcttgttgtgacaggattaaaggaaggagcattctacaaatttagag

SEQ ID NO: 285011 - DNA, 617 bp, Homo sapiens
gttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcac

SEQ ID NO: 285012 - DNA, 383 bp, Homo sapiens
tttttttaaatttcttataatcaatatgatctttttcacagctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattggtaagcctggaaaccattccttttttt

SEQ ID NO: 285013 - DNA, 512 bp, Homo sapiens
ctctttccaccatattttgaacccacatgtgaggcaacatgactcaaagtatgttcatagacatatccactatctgttaataaaagaaaaaacactttgctctcagctggtcattcaaagcaaagcttcacagacttactttcctagttcagtagaattagaagcatccccagttacaaaggtaaacaatctaaaatgttaaattaaaaaagcatacgtgcccttgatttatttttcactgataatcttgatgaaaagtttgctaagaaaaattctgtctacatgaatgtctataattttggcaactgacaagttttaggaatgattttaaataaggatgtaaggttatgccaaacagaaggctattttttacataattaagttgaagtgaaatattatttcttacatgaatatttatctcatgctaatcattttcacttgcctctggctaaaggtcctccaacatctccagagaggctcacatacactgaaaggacaaagtccactatcac

SEQ ID NO: 285014 - DNA, 510 bp, Homo sapiens
tgagcttagcattcccaaagcggtccgggaggacaaaggcacttacacagttactgcttccaatcgccttggctcagtgttccgaaatgttcacgttgaagtatatggtaagtgacttgctttcttacatcaaaaaggcatccagtgtctgtttaagaattgccttctcaatattctctgttgattcctttccagaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatggggtaaactcttctgaatattttcttatacacattaaaagtacatgactctggtttgatgccattttaatataaccttggaatttgataattaaactcaaaaccacacacgataagctgttatttt

SEQ ID NO: 285015 - DNA, 844 bp, Homo sapiens
aggtggaagaaaaaattgagcagctccacacaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcagg

SEQ ID NO: 285016 - DNA, 761 bp, Homo sapiens
cctttccctcgttggcaaagagccgcgtggctttcaaccaggcaattaaaaagtgcaagcgctgccagattcccaaaccccccttcaaaaaaaacggaaggcccaagcttggcttctgtgggccaaccaaccttattaattgcaccaggccaagggccaagttcttcgatgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcagg

SEQ ID NO: 285017 - DNA, 985 bp, Homo sapiens
aggtggaagaaaaaattgagcagctccacacaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggaaaaaaaaaaataataccttcacttttttagataatattacatgaatttttcataaaaaccccgaggggggccccggttcccaattcccccttaagggaggcagtttacaattcactgggcctgcttttatcaactttagg

SEQ ID NO: 285018 - DNA, 751 bp, Homo sapiens
aggtggaagaaaaaattgagcagctccacacaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggactggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcagg

SEQ ID NO: 285019 - DNA, 427 bp, Homo sapiens
gaacgtcgagaataaggacgagtgaccccaaaggcacacattgagaaggggtgccgttttaaacacagtcgacttcccgccctaatgaacccataataaatgcatcataaaaagagatggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggaaatcaggtcacatgactca

SEQ ID NO: 285020 - DNA, 490 bp, Homo sapiens
tcccagatgcctgaaacacaggcatctcttttccagtcagcccctaaagtagccttctgccggactctgacttacgtgtggaatcctctgtgacacctcatcttacccacagggacagacagacataatgatcaattgagccctcatatgtaaaatcgctgtccaaatgtgaaggcttaataatggtgccataatatgaggtgatcctttctttcctctttcttcccagtgggagtctcgggtgactcaatatgaaagggacttcgagaggatttcaacagtggtccgaaaagaagtgatacggtttgaggtgagatagaaaatcctacttctcacttagcatgcagtgcttgttttgggagtactcttggtgttgtccaactctgttgggtaaagagagaggtgccagtaacttggcagttctcgtgagcaggcgtggccttctttgggggggcggtgcgatctcagctcacaatcactagtgaattcc

SEQ ID NO: 285021 - DNA, 521 bp, Homo sapiens
cgagctcggtaccccttttggggtctttgctaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcagg

SEQ ID NO: 285022 - DNA, 896 bp, Homo sapiens
aggtggaagaaaaaattgagcagctccacacaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcagggacgatcttttctaatgcaatacaagcttaagaaagagggcgaccgcaagtc

SEQ ID NO: 285023 - DNA, 864 bp, Homo sapiens
aggtggaagaaaaaattgagcagctccacacaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggaaatcaggtcacatgactca

SEQ ID NO: 285024 - DNA, 805 bp, Homo sapiens
aggtggaagaaaaaattgagcagctccacacaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggtatatttttcaggatgtggtttaggaactgggaataacgttttctgttactcctgatggtgccatgaaaaggttatgtaataaaatattttaaaatcagg

SEQ ID NO: 285025 - DNA, 677 bp, Homo sapiens
gcggagcacccggcaatggcggcctccacggcctcgcaacggcccctcaaggggatcctgaaggacaacacctctacgacttcctctatggtggcgtcggccgaacatccccgtgggagtgtccacgagcagctgagcaaaaaatcccagaagtgggatgaaatgaacatcctggcgacatatcgtccagcagacaaagactatggtttaatgaaaatagatgaaccaagcactccttaccatagtacgatgggtgatgatgaagatgcatgtagtgatacagaaaccactgaagctatggcaacagatagcttgctaagaacttagctgctgctgaaggcttggagccaaagtatcaggttcaggaacaagaaagcagtggagaggaggatagtgacctctcacctgaagaacgagaaaaaaagcgacaatttgaaatgagaaggacgcttcactacaatgaaggactcaatatcaaactagctagacaattaatttcaaaagacctacacgatgatgacaaagttgaagaaatgttagagactgcacatggagaaagcatgaatacggaagaatcaaatcaaggatctactgcaagtgaccaacagcaaaataaatcacgaagttcatagaagggatttgttcaacactcttattgtttgttagatatgaacccc

SEQ ID NO: 285026 - DNA, 265 bp, Homo sapiens
ctcctggggtgcagaggatttgtgacagcctagagaacagaggaaatggttttgaaaaggcaaatggcagtgcctgaaccataaggcacaaggaatgagcccctcatcgtgagagtgcatgtgacaggagcaaaggaagcggcagctcaggaaagacaaggtcactgttcttgctcccatgacggtagcacttgttagagcaactgagtgacgtgcataattctctccaaagtaaaagtcctttttgttttttgcaattttacaa

SEQ ID NO: 285027 - DNA, 2388 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285028 - DNA, 1502 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285029 - DNA, 853 bp, Homo sapiens
  misc_feature (710)..(710): n is a, c, g, or t
  misc_feature (712)..(712): n is a, c, g, or t
ggccgacccaggagggcagtgggtgcctgggctgagccgcggcctcgacatggcctaacagtgagggcaggcccgagtttgccgagtgcagtccccgcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctggcctgtgggcatcagtgccgntncaaagggagggaaagtgggagaatgtgacatttttaaggggattagggattattttgttccgggctttattcatagttttgttgggcagtggtgtgaccgaactatgattgggagacgttacaatttcccagcattattgc

SEQ ID NO: 285030 - DNA, 710 bp, Homo sapiens
  misc_feature (524)..(524): n is a, c, g, or t
actctttttgtggtccgtgtgtgtgttagtgtgcgtgctcgtcgtggtttattattttttcttgttgtgctattctctcggtttttttcgtcctttttttttttggtctgctggccctattttttctcttttgttgtggtttcgtcctcgttttcgctcttctgttttttttttttcctcctcttgctttttttttttgttgtgtttttcgccccctttttttcctccccccgtttttgtttcttttccccaatgtgtgcctctttgtcccgtttttcctctcttttcctctttttttatttcctctcccgcgctcctttcgggttatatatataattccccctctttgtggtggccccccttttttccacaaaatgggggtggggcgcggttggggcgcccccccgcggagagaattttttgtcgcgcgcgccccccccctttttttttttttttttttttttttttttttttttttttttttttttttttttttttttttttttttttttttttttcagganccggtatttattatcaaagtcatattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285031 - DNA, 820 bp, Homo sapiens
  misc_feature (356)..(356): n is a, c, g, or t
  misc_feature (366)..(366): n is a, c, g, or t
accaccaagttgtaaaaacatacatctttacaacttggtggtcccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataaaaaaaaaaaaaaaaaaaaaaaaaacaaaaaaaaaaaaaaaaaaaaaanaaaaaaaaanaaaaaaaaaaaaaaaaaaaacgggggggcggcgcgtaaaaaaattccaccccgggggggcacaaccagtaagacgcgcactccacgatttgttaatcaacagagggggcccacacatgagagggcgcacattaaaaaagaggacgacgcgcggagccgtcttaaaacacaacgaggcgggaagctatggaaccaaaccaacgccccgacatggatattacttcgtttggaagagagacaccccatattgtcgggggggccgaaacaaaatttgttggcgaacccacatcatctccagacaaatatttacgcccgtgagaacataatcaacaacctcgcagggttatcattagtgactacccacacgcatcatcaaattattgccgctcgagaaagactgctccaccggagctattttatgaaaacatttataccgcgggtgcctaaattaatgg

SEQ ID NO: 285032 - DNA, 757 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccaggtgacatgactctcccgaacgttattttgatgtattttcagtgtagatttctcatattgattttcttttttccgctcttcagtcacccggagaaggcatgtgatcaaaacctcttggtgacattttttctaggccacaaagtaaggcaaaataacaaaatgattttgtaacttacctgacaagagaaaacatattggcgtttttttctcaatactgaattaaatagctgtagctgatgataatacctgtaataatagtggctgtaccaaataatagtacaaaacttgtcaactttcaaaaagtattatggccaggagcagtggctcacacttggaatccgagcactttgggaggcccaggcaggagacttacttgaggccaggagttggagaccagccctgggaataccctcgtctctactgcccccccac

SEQ ID NO: 285033 - DNA, 512 bp, Homo sapiens
  misc_feature (16)..(16): n is a, c, g, or t
  misc_feature (21)..(21): n is a, c, g, or t
gcacgagctcgtgccntgganatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285034 - DNA, 3173 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataaccccatgctgatgggttttatttagtataaaacatccatcaaacaccagtctctggcttctagaagagtccttcagatgacagttgttgtccatggtctttgactatcaagagcagaattaaatgtaatagtcccagagctgtagaaaagaactttactccttcccagggaaagtgaaagacataaaacactgaatcagaggtggcacagattagtctttgataaggtaacgtttctttgaagtctgtctgtagagaactacatggacttccaagagtgtcaaaggcagtgtggtagagagaatttaaggcaagatttaaatttggaaaaggtgcttgaaccttttctcagaggttttatttccccagtatgtttttcactggggcctttacttaggttagaaataataggctttgaaggcctctatcaccagatgcaataaccagataaaattcctgttttttcccaatcgcttagttttttgttgttgttgttttttaactgagtagatcattctgacccagaactactttcatgaggtaagatctttgggaaaatctgaatagcgttaaccattagattcaaatctcaaatggtttcttttcaagtctagttgttttagagtatagtgagaaataccttgacacaattttaagagtaaactatatgggtcagcatatccttgaacaaaaagtagactttgtaaaagtattcatttaaattctaacactcgtggcacaaaagaatggaaattgtaaacccatgtaatggaaattggctatctt

SEQ ID NO: 285035 - DNA, 2702 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataaaaaaaaaaaaaaaaaaaaaaaaaacatatactcatcaaatatttctattaaaataaaaaaaaaactcggggggggcccggccccaattcccctatgtgggtctttacaattactgccgtcgtttacaactctggactggaaaaccctgcttcccaacttaatgcttggacacatcccctttgccagtgcctataacaaaagccccaccatcgctttcaacattgcacctgatggcaatgcaattagactaatttttgtaaaatccttaaattttaaacatctttttaccatggccaatgcaaatctttaaaaaa

SEQ ID NO: 285036 - DNA, 2309 bp, Homo sapiens
aagctaggtacgagactggtgtgttaatcggcaccgaggacgtcacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285037 - DNA, 2307 bp, Homo sapiens
ggccgacccaggagggcagtgggtgcctgggctgagccgcggcctcgacatggcctaacagtgagggcaggcccgagtttgccgagtgcagtccccgcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285038 - DNA, 2552 bp, Homo sapiens
cgccagttccctgggaccgatttcggtcgcagctggcgaagccagcggtggggcccccggccagtgtttgtttctcttcctgcctccgatatcggtttctcggcctctgtcccgagcgtggggacaccgcttcctacccacaaggctcgaagctcgggcctcctcgtcgggcttgtgagtttcggcgcgcacgagcgtgctccgaaggcctggctggccccttggcctggaacgggtaacggagtgtttggcggggatggcccgaggagtttcggcgccgcgaaagtggagagtgtggatgcctctgccgtggggatttagacaaatcacctccatttcatgcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285039 - DNA, 2334 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285040 - DNA, 2510 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatgatggtctctcactttttcacccaggctggagtgcaatggtgcaatctcggctcactgcaacttccacctcccaggttcgatcgattctcctgcctcagccttctgagtagctgggactataggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285041 - DNA, 2556 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggcttcctggcctaatctgttgttgaaaccttgagttttagaagaagtcttcatgtttaaattctttttcttgtttttgggcaggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285042 - DNA, 2110 bp, Homo sapiens
cgtgcactggcccgtcgctaactgccgtctggattggagaaagtcctgaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285043 - DNA, 2256 bp, Homo sapiens
aatcagtttacacaaggaatttgaaagagggcaatccaaatgaagtcaacatggtcacacaaaaatcttggtaaaagaactagaatggaagcccaagctgctgagcaagtgggagaagaaaagaaaacatagtctaaacagatcacacaagggaacccaggacaaatgctgactttggcattatctaggtaaccaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285044 - DNA, 2480 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggaggctgagtgcagtggtgcgatctcactgcagcctccgcctcctgggttcaagtgattctcctgcctcagcctcctgagtagctgggattacagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285045 - DNA, 2242 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285046 - DNA, 1972 bp, Homo sapiens
gactctgcaggatctcctgtaacaggctgatgcgtacactacgacagtgagaaaggaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285047 - DNA, 1932 bp, Homo sapiens
aatcagctcggtccactcttacccacgactcttaccctcactggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285048 - DNA, 2199 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285049 - DNA, 1561 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285050 - DNA, 1425 bp, Homo sapiens
  misc_feature (1396)..(1396): n is a, c, g, or t
  misc_feature (1403)..(1403): n is a, c, g, or t
  misc_feature (1423)..(1423): n is a, c, g, or t
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatgtgggccagaaaaactttttttnattgaanaaaaaaccctgaaaaggaancc

SEQ ID NO: 285051 - DNA, 1522 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatgggtaagggtttagtcatttattttggggaggtgaaataagtgagacatagaatcaatttacatttgcatattctatgattacagataccatctctgatcatttcactcccaggtgtgattgtaagacttgtctatacattatcatttt

SEQ ID NO: 285052 - DNA, 1407 bp, Homo sapiens
gtatcaacgcagagtcgtcattacggccgggatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285053 - DNA, 1091 bp, Homo sapiens
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgtggcttgtgggaactgggcttgaacttgttgttcctt

SEQ ID NO: 285054 - DNA, 1220 bp, Homo sapiens
  misc_feature (16)..(16): n is a, c, g, or t
  misc_feature (21)..(21): n is a, c, g, or t
gcacgagctcgtgccntgganatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285055 - DNA, 1398 bp, Homo sapiens
cactgcactccagcctgggagacagagcaaggctccatctcaaaaggaaagaaaaataataatgcctggttaaagaactcaagaatgttggctatcaagacaaatagtatccacactgcagttttgtgggaatgtcctaatcaggcgtctggggatcagctgcttatttttattggaacatgatcatgctaattaatatttcattacccattataggttgtctccggatactttcatccaagagttgaatagttgtaacacagattgtgtggcccaaaagctataaagtatttactctctggcttcctggcctaatctgttgttgaaaccttgagttttagaagaagtcttcatgtttaaattctttttcttgtttttgggcaggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285056 - DNA, 862 bp, Homo sapiens
acaaattcaatgcaatttgcatcaaagtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcgtatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285057 - DNA, 934 bp, Homo sapiens
  misc_feature (791)..(791): n is a, c, g, or t
  misc_feature (793)..(793): n is a, c, g, or t
agcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctggcctgtgggcatcagtgccgntncaaagggagggaaagtgggagaatgtgacatttttaaggggattagggattattttgttccgggctttattcatagttttgttgggcagtggtgtgaccgaactatgattgggagacgttacaatttcccagcattattgc

SEQ ID NO: 285058 - DNA, 778 bp, Homo sapiens
actctttttgtggtccgtgtgtgtgttagtgtgcgtgctcgtcgtggtttattattttttcttgttgtgctattctctcggtttttttcgtcctttttttttttggtctgctggccctattttttctcttttgttgtggtttcgtcctcgttttcgctcttctgttttttttttttcctcctcttgctttttttttttgttgtgtttttcgccccctttttttcctccccccgtttttgtttcttttccccaatgtgtgcctctttgtcccgtttttcctctcttttcctctttttttatttcctctcccgcgctcctttcgggttatatatataattccccctctttgtggtggccccccttttttccacaaaatgggggtggggcgcggttggggcgcccccccgcggagagaattttttgtcgcgcgcgccccccccctttttttttttttttttttttttttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 285059 - DNA, 436 bp, Homo sapiens
ttgctgatgatcagaaacttatgatgtgagtagaatccattcagagtttctaaatatcttgtctacgttttatgtttagtcaccatttcaaggtttttttcctttgtttttttttcactgaagttgggatactcgttcaaacaatacttccaaaccaagccactcagttgatgctcacactgctgaagtgaactgcctttctttcaatccttatagtgagttcattcttgccacaggatcagctgacaaggtcagtttcgtttattttaatagaaaacatgatttctctaggtttttttgaattgcagagatattttacttacagtattttttttttcttaaaaaattgattactcttgcttttctttttgtacatagactgttgccttgtgggatctgagaaatctgaaacttaagttgcattcctttgagtcac

SEQ ID NO: 285060 - DNA, 662 bp, Homo sapiens
cttgagcaggtttcaattttgtctctgaaagtaggaagctatcagtctccctacatgactcgttccaccctttgtggatacttctacctgtagaaaaaaaggttggcaaacttggtggcatggtgaggacaaagggcattttgaaagaaccagtgactgaggtcagagtggggagctggtgttagctgtgggattcactgcagcgtcctaccacaaaggcaaagaagatgaaaatgcagcgtgcagtgctgggcttgattcccaagtcgcagtcgggctcccgctatgggtaggaggctttacactcagcctgggtcagcaccggagcatccaggcacttcagctcgtctgggtagtcagctgtgaggatcaggaagagatcaaagaaagtagaaatgtgggtgaggccagagaaggagacaataatctgggatggaacattgaagaggaacactgcctctggagaggactccaaaacgtggttgagtttctgcaggatatgcaaaaaccagtcttccccctggtggaactgtgtggctcttcactcaggatgagtcttcatgcacaagccttgcagcatgcaccggccacttaccaccgttctcccattacttttccatctgccattactgaacaccagtctgtgctactgtctgggtgta

SEQ ID NO: 285061 - DNA, 452 bp, Homo sapiens
tttcaagacagcgtcttgctttatcgaacaggctgcagtgcagtggagtgatcttggctcactgcaacctctgcctcccgggtttaagtgactctctgcctcagcctaaatctcaccatgactgtagtcttagtgaaatgcaaatagtgacaatcttgatatatttctatttcgatatatttttactacaggtaaagtgtaatgcttctaaaataaagtctgacaattcagaaagagtgctcaactcaacacatgactagcagcaacatgcttttggtttctagtgcctatcatgctagaatcctcttcttcacattccagtgtgccaactggtggagggagtgcgatagcacacatgtgtgcctttcaagtacaggcacagcattcaacaagatgacaaaaaaacaaaagcctacgtaagtacatactaaggagattgttaggaatcactg

SEQ ID NO: 285062 - DNA, 895 bp, Homo sapiens
tttcaagacagcgtcttgctttatcgaacaggctgcagtgcagtggagtgatcttggctcactgcaacctctgcctcccgggtttaagtgactctctgcctcagcctaaatctcaccatgactgtagtcttagtgaaatgcaaatagtgacaatcttgatatatttctatttcgatatatttttactacaggtaaagtgtaatgcttctaaaataaagtctgacaattcagaaagagtgctcaactcaacacatgactagcagcaacatgcttttggtttctagtgcctatcatgctagaatcctcttcttcacattccagtgtgccaactggtggagggagtgcgatagcacacatgtgtgcctttcaagtacaggcacagcattcaacaagatgacaaaaaaacaaaagcctacaataattaccttccaagtgactatttccaaggatctgctgcgtctgaaaaattatagctaaaaagtgctaggcttatataccaaaaatgatgggtttacctcttttaaaactaaaacaaaaccatcatagtgtgtaccaagcacctcacctcatttaagaaaatgtcatttttcaccaaagtcacttgactgtactgaaaaccatgctcagatgaagagtccaagtaagaagtatggaggagtgaaactgccctctggaagagagagtctgaactcaaggacactgtctcaaaaactgtaaaacacaaacaaaaataacgcagctatttaagattccaaaggatggggttaagggagacacactgaatatcactcaaaacatcacctattcctttcctatataactaagaaatatttgtactgtcttaacaaaatttaaaagacctctgatgtaaagaaaataacctaaataaattaga

SEQ ID NO: 285063 - DNA, 3120 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcggatgtcacagggggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285064 - DNA, 3054 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285065 - DNA, 2902 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285066 - DNA, 3317 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcggatgtcacagggggtacttggtgaaaagactccaatcctcaatgttttagaagcaggcaggcctgggcagcctcgcctcttggcctctgcaggtgcctctgtatgggaggccagagtttctgtcactaactttttctaagctcacaatgtctagaggtgggtgcgcttttccacgcagtggaacatgacttttctttgaatctctggcaggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285067 - DNA, 2795 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcgggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285068 - DNA, 2968 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcggatgtcacagggggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285069 - DNA, 2861 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcgggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcggatgtcacagggggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285070 - DNA, 3728 bp, Homo sapiens
  misc_feature (3728)..(3728): n is a, c, g, or t
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcaaaaaaaaaaaaaaaaaaaaaacaaaaaaaaaaaaaaaacaaaaaaagagggggggggggcaaaaaagtatatccccgagaggggcgccaattagcgtctacccagttttttgaccaggggggcccaaaagggagggaatataaacgaaagcacggagcgcgggtaaacacggcgcggacggggacaccagcgtgcccgggagaacactgggggagagggacccccaactcgcggggggggacaatagtgggcaccacccctgcagaatataagaccggaggaaaatcacacgacgggacaacgtcgcacccacgcgcaattcgcggcggcgaaaaatcggccccccggttatattgaaatgacgggggggcgccacagcagtctagctgacaacaagacaaaacaaagcagacgcagcgcggacaagcgaagggtggctaaggctgaacgtatgtagacggacgaggaggcagaggaggacggagtagtaacaacccgaccaccaccacacacaggtgacacagggagtaagaaacaagagacgacgatgagaccacgagaacgcacgaaagattaagaggaggtgcgagcctagcggacgcgaagaccagaacgactgactgaaggtcatccagccggcgggccgccaggccagctcgccctcgcgacccan

SEQ ID NO: 285071 - DNA, 1738 bp, Homo sapiens
gccttggcgaggaggagggtgcacttccccagcgaccctcggagcagcccggggtgctgtgggcattgggaaggaaggccagtaccagccccttatagcttccctcacttggggacttgtccctttgtctcaggctcaagaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285072 - DNA, 1575 bp, Homo sapiens
tccaacccaagtggacacgggagccacggccttcccatcacgccctttactctcctgcggtgtcaccagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285073 - DNA, 1563 bp, Homo sapiens
  misc_feature (18)..(18): n is a, c, g, or t
agagagagagagagaganagactcgtgccgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggc

SEQ ID NO: 285074 - DNA, 3609 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacgaaaagccgagaacccagggccagcagtggagcctcagcagaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcgaaaaaaaaaaacagcacacacacaaaaacaggggagcggacacgccatcaaaaaagtcacccatcaagggagccacaggacatacacgacatacaccgggcacgcgtagtgacccacaggagcccaaaaacaggagaccgtacagatcacgcaaggcgaacggtggacgcgcgagagagatgctactacacacaccgtcaggtggacctcgattggtgcgaaaaagcacgtgagaatcaagtgggggaaaattcatgtggacagcgcgggaaacctgtataacatgcgatgagtggagtgatgaccatgaagtgccggaccaacaggtacccaacagcaagaaattctacaaacggcgcccgacaagggcacaagccaccacaccacgcacaggacgacgcagggaacacacacgggggcagaaaaccgaccaaccggcgaggacggagcggcgcagaggctaaaagaacagtgcggcgcgcccccagcgcagcgacgagcaagagaccaccaagagcgacctcaaaccccagggccccagcccgcgagacacg

SEQ ID NO: 285075 - DNA, 3674 bp, Homo sapiens
  misc_feature (3674)..(3674): n is a, c, g, or t
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaggccagcgtaggagtcatcgacaacccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcaaaaaaaaaaaaaaaaaaaaaacaaaaaaaaaaaaaaaacaaaaaaagagggggggggggcaaaaaagtatatccccgagaggggcgccaattagcgtctacccagttttttgaccaggggggcccaaaagggagggaatataaacgaaagcacggagcgcgggtaaacacggcgcggacggggacaccagcgtgcccgggagaacactgggggagagggacccccaactcgcggggggggacaatagtgggcaccacccctgcagaatataagaccggaggaaaatcacacgacgggacaacgtcgcacccacgcgcaattcgcggcggcgaaaaatcggccccccggttatattgaaatgacgggggggcgccacagcagtctagctgacaacaagacaaaacaaagcagacgcagcgcggacaagcgaagggtggctaaggctgaacgtatgtagacggacgaggaggcagaggaggacggagtagtaacaacccgaccaccaccacacacaggtgacacagggagtaagaaacaagagacgacgatgagaccacgagaacgcacgaaagattaagaggaggtgcgagcctagcggacgcgaagaccagaacgactgactgaaggtcatccagccggcgggccgccaggccagctcgccctcgcgacccan

SEQ ID NO: 285076 - DNA, 2595 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagctgagcggggctcacctccctgactgggggtatcggcaactggagatcgtcggggagaagctgtcccggggctaccacgggagcacggtgtggaacgtggaggagcaccgatacggcgcgagccaggagcagagggagcgggaacgggagctgcactcacctgcgcaggtggacgtcagcaggaacctcagcttcatggcgagattctcggagctgcagtggaggatgctggcgctgagaagtgatgactcggaacacaagtacagctccagcccactggagtgggtcaccctggacaccaatattgcctactggctgcaccccaggaccagcgctcagatccacctacttggaaacatagtgatctgggtttcgggcagcctcgctctggccatctacgccctgctgtccttgtggtacctgctccgacggcgaagaaatgtccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctga

SEQ ID NO: 285077 - DNA, 2539 bp, Homo sapiens
  misc_feature (2539)..(2539): n is a, c, g, or t
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcgagaatgctctcatcactcagtcaaggctaatgcttttggaatcagtgttaatatttttcaatctattggccgtgttgtcctacctgaagttcttcaactgccaaaagcacagccctttttctctgagctggtggttctggctaacactgacaggggtcgcttgttcctgtgcagtgggcatcaagtacatgggtgtgttcacgtacgtgctcgtgctgggtgttgcagctgtccatgcctggcacctgcttggagaccagactttgtccaatgtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagagggaggactagctcggatcacccagggtcagccactggaggtggcctttgggtcccaggtcactctgaggaacgtctttgggaaacctgtgccctgctggcttcattcccaccaggacacctaccccatgatatatgagaacggccgaggcagctcccaccagcaacaggtgacctgttaccccttcaaagacgtcaataactggtggattgtaaaggatcccaggaggcaccagctggtggtgagcagccctccgagacctgtgaggcacggggacatggtgcagctggtccacggcatgaccacccgctccctgaacacgcatgatgttgcagcccccctgagcccccattcacaggaggtctcctgctacattgactataacatctccatgcccgcccagaacctctggagactggaaattgtgaacagaggatctgacacagacgtctggaagaccatcctctcagaggtccgctttgtgcacgtgaacacttccgctgtcttaaagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggcaaaaaaaaaaaaaaaaaaaaaacaaaaaaaaaaaaaaaacaaaaaaagagggggggggggcaaaaaagtatatccccgagaggggcgccaattagcgtctacccagttttttgaccaggggggcccaaaagggagggaatataaacgaaagcacggagcgcgggtaaacacggcgcggacggggacaccagcgtgcccgggagaacactgggggagagggacccccaactcgcggggggggacaatagtgggcaccacccctgcagaatataagaccggaggaaaatcacacgacgggacaacgtcgcacccacgcgcaattcgcggcggcgaaaaatcggccccccggttatattgaaatgacgggggggcgccacagcagtctagctgacaacaagacaaaacaaagcagacgcagcgcggacaagcgaagggtggctaaggctgaacgtatgtagacggacgaggaggcagaggaggacggagtagtaacaacccgaccaccaccacacacaggtgacacagggagtaagaaacaagagacgacgatgagaccacgagaacgcacgaaagattaagaggaggtgcgagcctagcggacgcgaagaccagaacgactgactgaaggtcatccagccggcgggccgccaggccagctcgccctcgcgacccan

SEQ ID NO: 285078 - DNA, 1209 bp, Homo sapiens
gggccccgcaggctcggtgaatcgaacgttgagcagggcggtgggtggtgcggagtgccgagcggcctcacccccaaccgtcggcccagtcggacggttccgaggcgttgccgggagccgggcgcggctctgtgtggactcggagaaacgcggggcgtctgcctgagcccgcttttctacaagatgtggggatttttgaagcgccctgtagtggtgacggctgacatcaacttgagccttgtggccctgactgggatggggttactgagccggctgtggcgactcacctacccgcgggctgtggtttttgacgaagtatattatgggcagtacatctctttttacatgaaacaaatcttcttcttggatgacagtgggccgccatttggccacatggtgctggccttgggaggttatttaggaggattcgatggcaattttttgtggaacagaattggagcagaatacagtagcaacgtgcctgtgtggtccctgcgcctgctgccagcactcgcgggggccttgtcggtccccatggcctaccagatagtgttggagctccacttttctcattgtgccgccatgggagctgctctgttgatgcttatcggtaagacctgcgcccctgcctgctcttgctgtcatgcagggaagaactgaccctttggcccggaagatcacatgggcttggtgggcgagctgcaccagaaagtgcatctggttcatccaaatttgacgctgcaagtcacccgctcccaggctgaccccgtggttatgggattgctgaattgtgggatcagactcttatcagcagtcggggtatggcagtagaaaactgcccagatgctgctgcaaagtccatgcacacgtgggcacctccatctccaaccaatcttgtgaccaaatgataacttccccttgttccaccacctcccaggccttggccaattgagatggactcgtgagtcagtggatcctcttcagagagggtcttccagctcacgtttatgaacagatgaaattaaagcagatgaaaagttagattaggctgggcgcagtggctcacacctataatcccaaagtgtggggattacaggtgtgagcctctgcgcctagtgctagatatcttttggtcctctaatattttgggggttggcccttggcttgtgacttcataaatacatcttcatttttctataatttaaacta

SEQ ID NO: 285079 - DNA, 216 bp, Homo sapiens
aaatcttcttcttggatgacagtgggccgccatttggccacatggtgctggccttgggaggtaggagtcatcaggagagtagcccctacccttcaggacctcaaatacatttaaaacttatcagtgcatttcttacaggcagaaaccaggtcttattattgatgcatcttgtttattgcttgccacagtactctagaaatatttgctgaatgggat

SEQ ID NO: 285080 - DNA, 289 bp, Homo sapiens
ctacaagatgtggggatttttgaagcgccctgtagtggtgacggctgacatcaacttgagccttgtggccctgactgggatggggttactgagccggctgtggcgactcacctacccgcgggctgtggtgtaagctaaatgactccattcccagggtgaatctagaattgtactttgtgacaggaggcgcccttactgaatagcataaatgggagagtgaaatcctggcttcttggtgataggtgtttttggcagtgagaggagagaccagtctgtccccaggacagcc

SEQ ID NO: 285081 - DNA, 344 bp, Homo sapiens
atgttaactccatttctgtcatgtctttgcagcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcggatgtcacagggggtacttggtgaaaagactccaatcctcaatgttttagaagcaggcaggcctgggcagcctcgcctcttggcctctgcaggtgcctctgtatgggaggccagagtttctgtcactaactttttctaagctcacaatgtctagaggtgggtgcg

SEQ ID NO: 285082 - DNA, 307 bp, Homo sapiens
ttgtatcgcttctgaagtaatgccttttttcatgagtgtttttcatcctcatacgttttcccttgctaccttaaaattgacatgtgtttcctctttgaaacagagaatgctctcatcactcagtcaaggctaatgcttttggaatcagtgttaatatttttcaatctattggccgtgttgtcctacctgaagttcttcaactgccaaaagcacaggtatggaaaatggagtgtcttcctagttaacgagaacagagattctgggtggtttgttgatctgagatggtccagtacctttttttgtttcg

SEQ ID NO: 285083 - DNA, 442 bp, Homo sapiens
agctggaactacagaggcatgcaccattgcacctggctaatttattttttatttttatcttttggtagagatggggtctccctatgttgcccaggctggttaggaactcctggctcaagctatactcttgtctcagccttccagactactaagattaggccgggcgcggtggctcacacctgtaatcccggcactttgggaggccgagggggtggatcacttgaggtcaggagctcgagagcagcctggccgacatgatgaaaccccgtctctactaaaaatgtaaaatattagccagttgtcgtggtgcgcacctgtagtcccagctacttgggaggctgaggcagaagaatcacttgaacccgggaggtggagggtgcagtgagatgagatagcgccactgcactctagcctgggcgacagagcaagattccatctcaaa

SEQ ID NO: 285084 - DNA, 1506 bp, Homo sapiens
gatgcttctgagtaagcaaagagaatttctaaatagctaaaagacagaaacattcctaaagtagacagtttggaatggctcaaaagaaaatgtgcagcttgcgtgaccaccccaaaagattgtcccacctaggcagctgaagaacaacaacttagccttggcaacaaagcaagatcccgtccttacaaaacaaacaaacaaacaaaccaaaaaaactaattggccaggtgtgttggtgcatgcctacagtcccagctacttgggaggctgaggcaagaggatcacttgaacctagggagttcgaggctacagtgccctatgatggcaccactgcattgaagtatgggtgacaagagcaagaccctgtccaaaaaaaaaaaaacgaagaacaacaacttacaacttacctttctacttctgaggagactgggagtcacagagtccctgccacaaggtggaggggtaacagatttgattggaagcagtgagttataaatggtgctgtgtcctctagccctctaaccaacacatgactgtacagctggcctctctgatactaaattttccccatgtgctaaagatcgtacaagaagagggttgcaaaatgaagagaatagattaattattatagttaattatatttcttggaaaatcaaccactggtgagacaccaaaacccagagaaactgaggaagtggttatatttgcatatgcatagaaatacacatacatgtttgcagataaatagaattttgtctaatatggtatgtactaaattgttaacaatagcttcctctggagagtggaacttagtgtcagaaggaacatctatcttgtttttaacactatacaacaaacatgttttattattttaatatttttaaagtggttattaaagagaccaatgactagtttgtgcaaaataaaaagaagccaggaagattctataatattaatagatcagatttgaggtgacacaagcctcaaacagaattaattcatccatgatgattgatgaagaaacttccctatggaaagaaaatatggattccattcaaagcactttattttggttatttagaatattaaaatatacatatcctctagctgtcttagaattctgattgattacttatgaaaacattttctccttctatggtacaatgttaacaataatacttatgaactaggctgctgtttgaagatagatagacagatgtgtgtatgtatctagaaagttatagttacatatagagtgtgtgtgtgtgtgtgtgtgtgtgtgtgtgtgtgtattcctttaatcctgtcatcagctctagaaagtataagttatcatctccagtttatagttgaggcacaaaaaggttaaatgagtagcccaaatcaaaaaagactatagccaggattcaagtccaaagagccccagcccaaagcttgtactcttggccactcttgtatatacttcttgagaaaaataaatgtattaaaaaggacaccaaccatagc

SEQ ID NO: 285085 - DNA, 381 bp, Homo sapiens
ccaccccctaaattgctgatcgagtaggtctgtgggccaaagaattttcattcctaataggttcctaggtaatggtgctggtctcgctttgagaaccactaatgtttatacttcagatgagccaaggttaatcaccagacccagatattgtatcttttttttttttttttttagttcaagggtatatgtgcaggatgtacaggtttgttacataggtaaacgtgctatagtggtttgctgcacagatcatttcatcacctaggtattaagcccagcatccattagctattcctgatgctctctctcctcccaccctcttatcccatactttaaaaatgacttagtctttttaaacaataagcacataccttatggacccat

SEQ ID NO: 285086 - DNA, 1287 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggcaacgtgttggaccttccggagcttctcagaagacagagggttttcttttgaggatttaaacctcagacacagggagctgacctattcaccttagaatcctctggggcacccattacagtgtctgtaccaaggaggcaacaaagaacggcggaacagactggagcagaaggaccacccagcagagccaagccaaatcactgaccctcagaggcctgatgtgaatgcttatggcttcagtccattggattctgcagtaatctgccgatctacagtattaccacagtaaataaccgatagacctgaaaacgaatgcatgccttgtgccaaaattgcaggaaacctcaccaggagaaacaattttatatgagggaatgtactctctcctttgcattttccctcaaatctatatttttagcccctcacttgtctctacagagcctcagttgcttaatctaattgctgactgaacatctccaggaaactgtgtgtacgtgtttgtattcatagtatatttatttattatctgtttacttccatgggatatagtctccataagagagtagtcatcattgtatttgttgatgcttaataaataatcattgaatggg

SEQ ID NO: 285087 - DNA, 2114 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggttgttcttttgggccacatctaagaaatctttgtctagccaaaagccacaaataatttctcattttttggcttctggaagatgtacagttaaatgttatatttgggactgttatctaatttgattaaattgcactctacaatatgatatttgaattgatgaaaaattagtaaatgttaatattttttaaagtagccaaatcttgcaatttatatataatagagaagactagaaaatcccccatatttatttcctcttacttcgtactactaaaatttgtatttaggcatttggtttctcagataaacattacattccccagtatatggttctatctggcttggtgacgacatgttgaacattaagatgtgagcagaagtaatacatacacactctttttcatgtctttaattgaatgggatattggcccattttttcttccagtttattacactgaatattgacatgttattttccaatattgagacaatcaatgacaagactttaagagtaacaatgtaaaaatacagaagttgtctgagtttatcaacaatcccctggattagaaccccctaccagttctaggtcatctaatatatagacattgtgttcagtagaaataaatatatatattttttattatgctttaagttctaggatacatgtgcacaacatgcaggtttgttacattggtatacacgtgccatgttggtttgctgcacccattaactcatcatttacattaggtatttctcctaatgctatccctccccctgcccccaccccccgacaggccctggggtgtgattttccccaccctgtgtccaagtgttctcattgctcaattcccacctatgggaatacatttttaaatcatttttgaaggtgttattacattctgattgaacattttcagaaagaataaatcatttaatacaagaagtgggccacttcatgtaacaaaacaaaccaccactacagcaacaacaacaaaaaacacaaatgaatgtgactttagctttgcaacatcgtgacagactagcaagttaatgacatttgttatgccatagaaaatatttgttgaattgccactctaatgactttatatcagccaactcattatcaacactagaaaagatgattaaaaaatacttcagtacgttcacgtgttggcttgttaacatttttaagagtctataagagaaaaatgcatccaatctcgacaaaaatatttttcaagtatcttgtaggtacgtacaactaactaccttgtgaacaaaagtcactatataattatataatttctgacacttaaaaaagattattgtgcaaaagaagatatatgttctaataccaaatccacatataaaataattgacttatttaaataatttaagatgctcttttatatatttatattaaaaactttacagagaa

SEQ ID NO: 285088 - DNA, 970 bp, Homo sapiens
gccatcactttttccttgatactacgaaccatcctgtcatgtgtttgtaccatatcagtagtgaaactgacagtgctctgataggggtatactcttttatcccaatctatatcccaatacccaatagcccagtattcttagaatccagttgtattcatactctcctggatcatttctgttcctttgtaatatagtccctttcttcccttacagctcatatgacattaacagacaagacacttttcagaaagacaggtaagtcatttgttaaaatctcactactgttgtttaacagaaacatatatatgcatgtatatgtgtgtactgtatggaaaaagtggaattagagtttatctagaaaagaaaaaattacctcatctaagtgcagaaatgaataatacttaaaccataccatacaattctctatcatatttccacagataagtcaaaaatttaaaaaatcttattgttcatgcataaatgcagaaaacaatacctctagtatatgtttgtgttctattgtactttcacagaaggtgtttgatacttaatactgtgtttattaagaaaaatctttgcaatggttatggaattaaaatttcatgtaaaaatgattatgtagatcaagaaaagttgcaattttctggattcctgatattttaaataaaagtagtttccaaaggtgatttttttattattttaatttttaatggaaattttcacaatataaccatcctacataattttatttttcaactattatttttgtcgactcattatttattaagaaacaatgatttttagatactaatttataattcttatgttataattaaaaatcagagttcgttgaataaaatatctgatttatgactccttaagtcaacattaaattattttattgctatatcatgttttttgatgttcataactctaggtttatatagtaatttcactccactttcttttt

SEQ ID NO: 285089 - DNA, 1746 bp, Homo sapiens
catctcatttaatttgtatttctctaatggctaaagatattgaacatcttttgatgtgattatttgctgtctctgaatttcctctggcaaagtatgtgttcaagtatattcttttccttattgtttattgttggtctgtaattttccttataattgagtttacatattttggatacacattctttatcagatataatttggaaatgtctattcctagtttgaagcatatagggtagaaatatagaattttttgtttttatgaagtcatatctattgttgttgtaactggtttttttgtttgttctctaggttgttcttttgggccacatctaagaaatctttgtctagccaaaagccacaaataatttctcattttttggcttctggaagatgtacagttaaatgttatatttgggactgttatctaatttgattaaattgcactctacaatatgatatttgaattgatgaaaaattagtaaatgttaatattttttaaagtagccaaatcttgcaatttatatataatagagaagactagaaaatcccccatatttatttcctcttacttcgtactactaaaatttgtatttaggcatttggtttctcagataaacattacattccccagtatatggttctatctggcttggtgacgacatgttgaacattaagatgtgagcagaagtaatacatacacactctttttcatgtctttaattgaatgggatattggcccattttttcttccagtttattacactgaatattgacatgttattttccaatattgagacaatcaatgacaagactttaagagtaacaatgtaaaaatacagaagttgtctgagtttatcaacaatcccctggattagaaccccctaccagttctaggtcatctaatatatagacattgtgttcagtagaaataaatatatatattttttattatgctttaagttctaggatacatgtgcacaacatgcaggtttgttacattggtatacacgtgccatgttggtttgctgcacccattaactcatcatttacattaggtatttctcctaatgctatccctccccctgcccccaccccccgacaggccctggggtgtgattttccccaccctgtgtccaagtgttctcattgctcaattcccacctatgggaatacatttttaaatcatttttgaaggtgttattacattctgattgaacattttcagaaagaataaatcatttaatacaagaagtgggccacttcatgtaacaaaacaaaccaccactacagcaacaacaacaaaaaacacaaatgaatgtgactttagctttgcaacatcgtgacagactagcaagttaatgacatttgttatgccatagaaaatatttgttgaattgccactctaatgactttatatcagccaactcattatcaacactagaaaagatgattaaaaaatacttcagtacgttcacgtgttggcttgttaacatttttaagagtctataagagaaaaatgcatccaatctcgacaaaaatatttttcaagtatcttgtaggtacgtacaactaactaccttgtgaacaaaagtcactatataattatataatttctgacacttaaaaaagattattgtgcaaaagaagatatatgttctaataccaaatccacatataaaataattgacttatttaaataatttaagatgctcttttatatatttatattaaaaactttacagagaa

SEQ ID NO: 285090 - DNA, 1043 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggcaacgtgttggaccttccggagcttctcagaagacagagggttttcttttgagatccctcccgtagctgtcatacagagtgcgatttatgacttgtaagttgtgctatggagcttgacaaccaaaccttcaatacatttatgaagagagcactaccgagactttatacaatggaataaaataacaaaatgtgctgacagcattcttccactcaaagagaaaaagtacttcaactcggccgggcacggtggctcacgcctgcacgcctgtaatctcagcactttgggaagccgagacgagcggatcacgaggtcaggagatcgagaccatcctggctaacacggtgaaaccgtgtctctactaaaa

SEQ ID NO: 285091 - DNA, 1201 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacagatttttaaaattttcctcacaaaaggaaggaaggaacggaaggaaccgcaaggaaggcaggcaggcaggcacggcctgtccctccacctatgaggttggctttgtgatgtgttcaccatggtggccagggacatatcagctccagtgagccgagaatggaggacatggtgcttcttcaaggcacaatgaccactcacccctggatggagccgggaggaccattattcttaggtggcagaaattcaagttcgagggtgaagatgagttgaccgaaaagtggcttgtgtgttgacccagtgttgacccttccatcagataactttgtgccgtgtgcttgggtccacccctgagttgaaactgttcttccattagcctggtgcgttcactgtgggaacgcgcgtcagagagggggattttgcgaaccacaagtgcgacattgcgctcttccatgttcacggcgttgggcaaacggcgcgtgagtccagacgcgctttacagattgtataaaacaggctgcgacgtta

SEQ ID NO: 285092 - DNA, 3115 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggcaacgtgttggaccttccggagcttctcagaagacagagggttttcttttgaggtaaatttgatagtacattttgatagtacgggaggcgatacggcatggtgacagaaaagcgccggcttggttagcaggaccacctggcagggctgcaggctgtgccacttaccaggcaggggaccttgggccagctgcttggcctcactcaccctgtttctcagctgcaattgggatgaacagactgcctgcttcggggttgcctaaaactcacattggttaatgatgtgaaatgcttagcgcagtgcctggcatagagagaattctcattagatgatacctcagctgggctttaggagctacagaagaagctgcatctccatgagctcagcgtgtttctagctttcctttttgttttctattcaacctttcacccaactcagcttctcaatccctaaatgacaaaggtttgggaaggaagacttggaccgaggcttgcatttgtttctgagaattaaacgttatgttttcttcaatctaaataggtttgcttgtacagccttgttgaatggtttttttttttttctccatgataaatgactctcaacttcttttccctcatctaattgcttatctacatacaatgcctggaaggaaataaatgtaatggcccgtagcaactggccttcaggtatcaagtttaagtccctttaagcagaacagcaaattgagcacagaatgaactggtttcatggtagcgtactgcaattagatgcaagaatagggaaagcagggtgcttcaagtggtgacacaattagtatagcactgagggacttctctttccacttcttcaactccgcctgcattccgctggctgaagagttgatgacatccctgaaaaatcttccctctcttgtttctctgatgccacctctgtgttctccgcctcactggccacacttcctttacctcccaaacttttaactctgagtgtcccaaacttgtctcatcacctacccctgctgcccagctccccagcctgttccccttctgacacgggcactctccttctgctctcttgggagagaaacaatgaaggcctatttggcacttttatttctattcaaggaaccagactgtgaacaagtttaccagttagtcctttggactgtgtcttgaattcatccctcttctccattctcaccagcaccatcatcatgatggctaatatttcctgagcacctttcattcaggcatgatgccaggtgcaccaacttacttaatcctcatagccaccacctgagcaagctcctgttttataaatggaccagttcttgttgctgttgtacaagttattttctttctataacgtcctccttgtcctccttccacattcttaaagaaactttcccttcctttaaagtactcagggagccctgcattgcttcttgaagccttctccagcttcatcatctcacagtggtctctcttttcactaaatgtccaatatgctgcacataagtaccccaaagttagcacagaattgttccatggctgtcatatatgttaaaaatcattaaaagttcattttttctcccattatgggaaggatacatgctcctactagtaaatttagttggtagaaaaaaattatcactatctagactgctttccctttagtctttatgcatagctttctgtctgcctatttttactttgtgtttgtaacttactattataaaatatgcatctctatgttcattgtcaacattatttacaataacatggagtggatttacatgtattctctatatttggattaaaggagatagagtatgtgaaattaaatgggagaagtatctgatacataacaggcaatacaaatattatcacatagcgtcaatttatttgtgaatattgaaagctccaaaaaagaaaaaaagtttttttttaattcccgtaattacttattgcagtattgtgttcatacaaactgctcagtcattttggagaaataacaatttttttcctcatcatgaagtaaggtatgctcactgcaaaaaaaatctagaaaataaagaggaacatgctaaagaaaagaatactcccatataatctctgtcttcataaataatcttttgtaacgcttatacactgctggtgggaatgtaaattagttcagccattgtgaaaagtagcgtagcaattccttgaaaaacttaaaatagaattaccgttcaacccagcaatcccattattgggcatatacccagtggaatgtaaatcatcctgccataaaaacacatgcacatgtatgttcattgcagcactattcacaatagcaaagacatggaatcaacctatatgcccatcaatagtagactgaataaagaaaatatggtacatattcaccacagaatactaagcagccataaaaaagaaa

SEQ ID NO: 285093 - DNA, 2880 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggcaacgtgttggaccttccggagcttctcagaagacagagggttttcttttgaggtaaatttgatagtacattttgatagtacgggaggcgatacggcatggtgacagaaaagcgccggcttggttagcaggaccacctggcagggctgcaggctgtgccacttaccaggcaggggaccttgggccagctgcttggcctcactcaccctgtttctcagctgcaattgggatgaacagactgcctgcttcggggttgcctaaaactcacattggttaatgatgtgaaatgcttagcgcagtgcctggcatagagagaattctcattagatgatacctcagctgggctttaggagctacagaagaagctgcatctccatgagctcagcgtgtttctagctttcctttttgttttctattcaacctttcacccaactcagcttctcaatccctaaatgacaaaggtttgggaaggaagacttggaccgaggcttgcatttgtttctgagaattaaacgttatgttttcttcaatctaaataggtttgcttgtacagccttgttgaatggtttttttttttttctccatgataaatgactctcaacttcttttccctcatctaattgcttatctacatacaatgcctggaaggaaataaatgtaatggcccgtagcaactggccttcaggtatcaagtttaagtccctttaagcagaacagcaaattgagcacagaatgaactggtttcatggtagcgtactgcaattagatgcaagaatagggaaagcagggtgcttcaagtggtgacacaattagtatagcactgagggacttctctttccacttcttcaactccgcctgcattccgctggctgaagagttgatgacatccctgaaaaatcttccctctcttgtttctctgatgccacctctgtgttctccgcctcactggccacacttcctttacctcccaaacttttaactctgagtgtcccaaacttgtctcatcacctacccctgctgcccagctccccagcctgttccccttctgacacgggcactctccttctgctctcttgggagagaaacaatgaaggcctatttggcacttttatttctattcaaggaaccagactgtgaacaagtttaccagttagtcctttggactgtgtcttgaattcatccctcttctccattctcaccagcaccatcatcatgatggctaatatttcctgagcacctttcattcaggcatgatgccaggtgcaccaacttacttaatcctcatagccaccacctgagcaagctcctgttttataaatggaccagttcttgttgctgttgtacaagttattttctttctataacgtcctccttgtcctccttccacattcttaaagaaactttcccttcctttaaagtactcagggagccctgcattgcttcttgaagccttctccagcttcatcatctcacagtggtctctcttttcactaaatgtccaatatgctgcacataagtaccccaaagttagcacagaattgttccatggctgtcatatatgttaaaaatcattaaaagttcattttttctcccattatgggaaggatacatgctcctactagtaaatttagttggtagaaaaaaattatcactatctagactgctttccctttagtctttatgcatagctttctgtctgcctatttttactttgtgtttgtaacttactattataaaatatgcatctctatgttcattgtcaacattatttacaataacatggagtggatttacatgtattctctatatttggattaaaggagatagagtatgtgaaattaaatgggagaagtatctgatacataacaggcaatacaaatattatcacatagcgtcaatttatttgtgaatattgaaagctccaaaaaagaaaaaaagtttttttttaattcccgtaattacttattgcagtattgtgttcatacaaactgctcagtcattttggagaaataacaatttttttcctcatcatgaagtaaggtatgctcccggccacaaactctgacaccaagaggaactgtcttagaaagattctcccatatatcttgtttcgtaatatctagtacgctttaactgtttgtgaagtactgttccctgttaattggctccattcggtacatagagaaccccacttagggttccg

SEQ ID NO: 285094 - DNA, 3031 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatgctcatatgacattaacagacaagacacttttcagaaagacaggcaacgtgttggaccttccggagcttctcagaagacagagggttttcttttgaggtaaatttgatagtacattttgatagtacgggaggcgatacggcatggtgacagaaaagcgccggcttggttagcaggaccacctggcagggctgcaggctgtgccacttaccaggcaggggaccttgggccagctgcttggcctcactcaccctgtttctcagctgcaattgggatgaacagactgcctgcttcggggttgcctaaaactcacattggttaatgatgtgaaatgcttagcgcagtgcctggcatagagagaattctcattagatgatacctcagctgggctttaggagctacagaagaagctgcatctccatgagctcagcgtgtttctagctttcctttttgttttctattcaacctttcacccaactcagcttctcaatccctaaatgacaaaggtttgggaaggaagacttggaccgaggcttgcatttgtttctgagaattaaacgttatgttttcttcaatctaaataggtttgcttgtacagccttgttgaatggtttttttttttttctccatgataaatgactctcaacttcttttccctcatctaattgcttatctacatacaatgcctggaaggaaataaatgtaatggcccgtagcaactggccttcaggtatcaagtttaagtccctttaagcagaacagcaaattgagcacagaatgaactggtttcatggtagcgtactgcaattagatgcaagaatagggaaagcagggtgcttcaagtggtgacacaattagtatagcactgagggacttctctttccacttcttcaactccgcctgcattccgctggctgaagagttgatgacatccctgaaaaatcttccctctcttgtttctctgatgccacctctgtgttctccgcctcactggccacacttcctttacctcccaaacttttaactctgagtgtcccaaacttgtctcatcacctacccctgctgcccagctccccagcctgttccccttctgacacgggcactctccttctgctctcttgggagagaaacaatgaaggcctatttggcacttttatttctattcaaggaaccagactgtgaacaagtttaccagttagtcctttggactgtgtcttgaattcatccctcttctccattctcaccagcaccatcatcatgatggctaatatttcctgagcacctttcattcaggcatgatgccaggtgcaccaacttacttaatcctcatagccaccacctgagcaagctcctgttttataaatggaccagttcttgttgctgttgtacaagttattttctttctataacgtcctccttgtcctccttccacattcttaaagaaactttcccttcctttaaagtactcagggagccctgcattgcttcttgaagccttctccagcttcatcatctcacagtggtctctcttttcactaaatgtccaatatgctgcacataagtaccccaaagttagcacagaattgttccatggctgtcatatatgttaaaaatcattaaaagttcattttttctcccattatgggaaggatacatgctcctactagtaaatttagttggtagaaaaaaattatcactatctagactgctttccctttagtctttatgcatagctttctgtctgcctatttttactttgtgtttgtaacttactattataaaatatgcatctctatgttcattgtcaacattatttacaataacatggagtggatttacatgtattctctatatttggattaaaggagatagagtatgtgaaattaaatgggagaagtatctgatacataacaggcaatacaaatattatcacatagcgtcaatttatttgtgaatattgaaagctccaaaaaagaaaaaaagtttttttttaattcccgtaattacttattgcagtattgtgttcatacaaactgctcagtcattttggagaaataacaatttttttcctcatcatgaagtaaggtatgctcactgcaaaaaaaatctagaaaataaagaggaacatgctaaagaaaagaatactcccatataatctctgtcttcataaataatcttttgtaacgcttatacactgctggtgggaatgtaaattagttcagccattgtgaaaagtagcgtagcaattccttgaaaaacttaaaatagaattaccgttcaacccagcaatcccattattgggcatatacccagtggaatgtaaatcatcctgccataaaaacacatgcacatgtatgttcattgcagcactattcacaatagcaaagacatggaatcaacctatatgcccatcaatagtagactgaataaagaaaatatggtacatattcaccacagaatactaagcagccataaaaaagaaa

SEQ ID NO: 285095 - DNA, 1392 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggtaagtcatttgttaaaatctcactactgttgtttaacagaaacatatatatgcatgtatatgtgtgtactgtatggaaaaagtggaattagagtttatctagaaaagaaaaaattacctcatctaagtgcagaaatgaataatacttaaaccataccatacaattctctatcatatttccacagataagtcaaaaatttaaaaaatcttattgttcatgcataaatgcagaaaacaatacctctagtatatgtttgtgttctattgtactttcacagaaggtgtttgatacttaatactgtgtttattaagaaaaatctttgcaatggttatggaattaaaatttcatgtaaaaatgattatgtagatcaagaaaagttgcaattttctggattcctgatattttaaataaaagtagtttccaaaggtgatttttttattattttaatttttaatggaaattttcacaatataaccatcctacataattttatttttcaactattatttttgtcgactcattatttattaagaaacaatgatttttagatactaatttataattcttatgttataattaaaaatcagagttcgttgaataaaatatctgatttatgactccttaagtcaacattaaattattttattgctatatcatgttttttgatgttcataactctaggtttatatagtaatttcactccactttcttttt

SEQ ID NO: 285096 - DNA, 1283 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggcaacgtgttggaccttccggagcttctcagaagacagagggttttcttttgagatccctcccgtagctgtcatacagagtgcgatttatgacttgtaagttgtgctatggagcttgacaagtaagtttgatttcatttaatattttctttaaaccatcttagatcttctctttgacaagtatttcatctgttagtgttctcaaaatgtaaaatgggtaacttaatgagaacaaaaattgtaccctaagacatatttgcactatctacatatttgcaattaaatcttaacagatttaattgtaatagaatctaatggttttcctcttgaatttttttagacaccagaaattttcattactaataaataatgtttagcttcctagtcacaaaccaaacagaaagcaaatttcatcagagtttagaatggttaaaaccaacatagctgcaatatttttagttttgctttaaaattttttgaatcaatcagtaaatcaatcagagttgaccattatgtaatccacagaccttgaaataacagagatatatttctccgcagatcaatatctatatatgtttttaagatgagtagaattccctgaagatca

SEQ ID NO: 285097 - DNA, 945 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggcaacgtgttggaccttccggagcttctcagaagacagagggttttcttttgagatccctcccgtagctgtcatacagagtgcgatttatgacttgtaagttgtgctatggagcttgacaaaaaaagtacttcaactcggccgggcacggtggctcacgcctgcacgcctgtaatctcagcactttgggaagccgagacgagcggatcacgaggtcaggagatcgagaccatcctggctaacacggtgaaaccgtgtctctactaaaa

SEQ ID NO: 285098 - DNA, 970 bp, Homo sapiens
cgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgtactgagaaaacttcagagacctaaactttttccagagaagagaagctttactggtgttccagccctaagaaacctttgttcaagaaaacggcagatgctctgttgaatccactggagattgtcctgatactaaggacaagtatcaaccatctttcctgtgaaaaattccctctcgtactttagttctgtggatccaaaatttatagcattcttctaccaccacaggggctcatatgacattaacagacaagacacttttcagaaagacagccgggtgcggtggctggagcctgtaatccaagcactttgggaggccgaggtgggtggatcacctgagatctggagttcgagaccagcctggccaacaaggtgaaaccccacctctattaaaaatacaaaaattagctgggtgtggtggcacacacctgtactcccagctacttgagaggttgaggcaggagaatcgcttgaactcgggagacggaggttgcagtgagccaatattgcgccattgcactccagcctgggcaacaagagcgaaattccatctcaaaaaataaaaa

SEQ ID NO: 285099 - DNA, 3626 bp, Homo sapiens
cccgtggagaaggacgggacggagccggggcagccagaagaggtgggaaaagcggaggaggacgcccaggaggaggcggcggcggcggccgggaagtgaaaggtctcgcaaagttcagcggcggctgcgggcgccgagccccgggctagcggcagacgagcccgcagggccgctccgcggggcagcgcagccaggccggctatggtcccggggctcccgccgccccccaggtgcccgggacccgccaggccggtgcgcgagggtcaccccacctccccgcgcggtcccggcccctggctcccagctgccggcgaccgctgaccgagcccggcgccccaggaggaggaagaaaccagggccccgttccctcccgaggacggcggcgcttcatcccgcagcccagaggtctcggctccctccggcacccgcccggcccggctgctcccggctcctcccggccatggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctga

SEQ ID NO: 285100 - DNA, 406 bp, Homo sapiens
cgatgagtaaattttggcacactaaggggtattttaacacatttttgtttgttttctgatgattagagtaatatatgtagttggtatagaaaatttggaaaatgcaaaacatcatagtaaaaaaaaaaaaaaaagaggtcacccaaaatctcattattccactgttaatactttggtatgtttttctcactctaaaacacagttaagagcctactgagtggggtgagtataatcccagcattttgggagaccaaggcagaaggattgcttaaggctaagagttcaagaccagcctgggaaacatagcaagagttatctctacaaaaataaaaagttagcccagtgtggtggtgcacgcctgtagtcccagctacttgagaggctaaggtgggaggatcacttgagc

SEQ ID NO: 285101 - DNA, 323 bp, Homo sapiens
  misc_feature (4)..(4): n is a, c, g, or t
gggntccccccccgggccttccagggaatttcgggccacggagggaattaattttccaccatggcactgtgttcatgttttgtatattcaagtacaaaagaaactatgtatagtggttatgcgtgggtacagaagatgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctga

SEQ ID NO: 285102 - DNA, 3275 bp, Homo sapiens
gagcggaacagaggacccagctcgccatcccccggcacttcatggcctaaggaatgatgaggaggggtggcccagcgaccctgggcgcgcgtgggctggggccggtctctggtagaagcccatcgctggtgtccctgacctggtgctgggtactagagaaccaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctga

SEQ ID NO: 285103 - DNA, 3819 bp, Homo sapiens
cccgtggagaaggacgggacggagccggggcagccagaagaggtgggaaaagcggaggaggacgcccaggaggaggcggcggcggcggccgggaagtgaaaggtctcgcaaagttcagcggcggctgcgggcgccgagccccgggctagcggcagacgagcccgcagggccgctccgcggggcagcgcagccaggccggctatggtcccggggctcccgccgccccccaggtgcccgggacccgccaggccggtgcgcgagggtcaccccacctccccgcgcggtcccggcccctggctcccagctgccggcgaccgctgaccgagcccggcgccccaggaggaggaagaaaccagggccccgttccctcccgaggacggcggcgcttcatcccgcagcccagaggtctcggctccctccggcacccgcccggcccggctgctcccggctcctcccggccatggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctgaaaaaaaaaacaaaaaaaaaaaggggggggaaaaaaccaggggcaaattaggaacccggttttggaaggggccaagagggtataaagaggggcgggaaagcggggaaaagccgggttggagactttggggaaggaccaagaaaggcgaaaaagtgggaccgggtcggttgtgacacaaacgctaaacattaata

SEQ ID NO: 285104 - DNA, 990 bp, Homo sapiens
gggctgcaggaattcggcacgagcaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctga

SEQ ID NO: 285105 - DNA, 2620 bp, Homo sapiens
cccgtggagaaggacgggacggagccggggcagccagaagaggtgggaaaagcggaggaggacgcccaggaggaggcggcggcggcggccgggaagtgaaaggtctcgcaaagttcagcggcggctgcgggcgccgagccccgggctagcggcagacgagcccgcagggccgctccgcggggcagcgcagccaggccggctatggtcccggggctcccgccgccccccaggtgcccgggacccgccaggccggtgcgcgagggtcaccccacctccccgcgcggtcccggcccctggctcccagctgccggcgaccgctgaccgagcccggcgccccaggaggaggaagaaaccagggccccgttccctcccgaggacggcggcgcttcatcccgcagcccagaggtctcggctccctccggcacccgcccggcccggctgctcccggctcctcccggccatggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctgttcaacagccaaggccaaagaaagctgataagaaaactgaaaccttacacgccaacctgcttccttggctactttggaaaagaaacaatcctattgggtatccctgcatattcattcattcttaattcatgcatacatttactcattcatcagtcatatattttagaacaccaaaactagcactaaagtattgtatcttctttttctatggatacaaaataaacttcgtgttctcagacgtgtagcaaagtagatgtcaaaaccctagagataggaaaataaaatataaatgctaataagaggtataaaagaacattgttttgcatatttgtttttggtgtgatgctgcttcataatttatggttttattcagtattgtttttatcaatttaacttatatttatacttta

SEQ ID NO: 285106 - DNA, 1199 bp, Homo sapiens
cccgtggagaaggacgggacggagccggggcagccagaagaggtgggaaaagcggaggaggacgcccaggaggaggcggcggcggcggccgggaagtgaaaggtctcgcaaagttcagcggcggctgcgggcgccgagccccgggctagcggcagacgagcccgcagggccgctccgcggggcagcgcagccaggccggctatggtcccggggctcccgccgccccccaggtgcccgggacccgccaggccggtgcgcgagggtcaccccacctccccgcgcggtcccggcccctggctcccagctgccggcgaccgctgaccgagcccggcgccccaggaggaggaagaaaccagggccccgttccctcccgaggacggcggcgcttcatcccgcagcccagaggtctcggctccctccggcacccgcccggcccggctgctcccggctcctcccggccatggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggtaagggcacctgtttaactctacactgtaagtaagatagaaaaatgttaccagcccgcatttttttttaaagcatgaagctatacttgtagcaacatgaatgaaattagaatttttcatgagatttatttgtcataaattatttcttaccctt

SEQ ID NO: 285107 - DNA, 332 bp, Homo sapiens
acaataagagcgaaccagcctgggagtgggaggatgcgcaggggttttctgcacttctacactcaggtgagatggatgtaaccaggcatcatattttcaggtctggtcttatgtaacagtgatacgtgacaaaccagggtccagcttttggatcctatgaggggaactctttagttctggggtttcatggtataataaagtagtgactcctgtaagtatgaaactgtaaaatatagctaaggggtattttaacacatttttgtttgttttctgatgattagagtaatatatgtagttggtatagaaaatttggaaaatgcaaaacatcatag

SEQ ID NO: 285108 - DNA, 3241 bp, Homo sapiens
cctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggatagcattgggcagctggagaatgatctgaggaacaccaagagtgagatggcacgccaccttcgggaataccaggacttgctcaatgtcaaaatggctcttgacattgagatagcagcttacaggaaactgctggaaggcgaggagacacgttttagcaccagtgggttaagcatttcggggctgaatccacttcccaatccaagttacctgctcccacctagaatcctcagtgctacaacctccaaagtctcatccactgggctatcacttaagaaagaggaggaggaggaggaggcatctaaggtagcctctaagaaaacctcccagataggggaaagttttgaagaaatattagaggagacagtaatatctactaagaaaaccgagaaatcaaatatagaagaaaccaccatttcaagccaaaaaatataattccattgctttgaaaaagttaatgcttaagagggaatgatatgcatttgacttgttaaacagcctattcctgaactataacacctgccaccactataaaatgtcttcaaggcttcagtctcatatttagtattgaatacttacattctctaataagaaaaccaccccttagattgaagtaaactgcagtcctggagcaatcacagatgagttatctaagaatacagctttctgaccttcagctcacgcttcacagtgatcgatgattcaggtgcagaggaagtacaaactaaggtgctaaatctgcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatgcctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaactattaaggatgtagcttttcacctttactttagaagcacagtaaatatcccaaactgtgatgaagccgaccttagatttagtagtgtaagctagaagaagtgagtgtttctatgagtggaaaaagccaaggtgtcatttatgtgtcagttcatttgtggtgatatagaattagctttttcatccccttacccttagaatccacgtattccccttcccactagcctaggtcataaagaggcgttgctttcactctcctatgccttttacgagtgctaagtgtaggatattttgtcaccagaacacaatgctaccgccccaaagtaaaagaaaccacttctggtcaatcaacactaccagcgtatatataagaaagacatctttctcttttctaaaagacttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgtgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttgaaaaatacttttccttacctttaccccatccctgtctttactcctcacacttactgtaagacattagtaacataataaattaaaagtcacacgaatctcaccaacataa

SEQ ID NO: 285109 - DNA, 3281 bp, Homo sapiens
cctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggatagcattgggcagctggagaatgatctgaggaacaccaagagtgagatggcacgccaccttcgggaataccaggacttgctcaatgtcaaaatggctcttgacattgagatagcagcttacaggaaactgctggaaggcgaggagacacgttttagcaccagtgggttaagcatttcggggctgaatccacttcccaatccaagttacctgctcccacctagaatcctcagtgctacaacctccaaagtctcatccactgggctatcacttaagaaagaggaggaggaggaggaggcatctaaggtagcctctaagaaaacctcccagataggggaaagttttgaagaaatattagaggagacagtaatatctactaagaaaaccgagaaatcaaatatagaagaaaccaccatttcaagccaaaaaatataattccattgctttgaaaaagttaatgcttaagagggaatgatatgcatttgacttgttaaacagcctattcctgaactataacacctgccaccactataaaatgtcttcaaggcttcagtctcatatttagtattgaatacttacattctctaataagaaaaccaccccttagattgaagtaaactgcagtcctggagcaatcacagatgagttatctaagaatacagctttctgaccttcagctcacgcttcacagtgatcgatgattcaggtgcagaggaagtacaaactaaggtgctaaatctgcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatgcctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaactattaaggatgtagcttttcacctttactttagaagcacagtaaatatcccaaactgtgatgaagccgaccttagatttagtagtgtaagctagaagaagtgagtgtttctatgagtggaaaaagccaaggtgtcatttatgtgtcagttcatttgtggtgatatagaattagctttttcatccccttacccttagaatccacgtattccccttcccactagcctaggtcataaagaggcgttgctttcactctcctatgccttttacgagtgctaagtgtaggatattttgtcaccagaacacaatgctaccgccccaaagtaaaagaaaccacttctggtcaatcaacactaccagcgtatatataagaaagacatctttctcttttctaaaagacttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgtgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttgaaaaatacttttccttacctttaccccatccctgtctttactcctcacacttactgtaagacattagtaacataataaattaaaagtcacacgaatctcaccaacataaaaaattcacttggccgtcgttttaccacgttgtgctgggc

SEQ ID NO: 285110 - DNA, 479 bp, Homo sapiens
ctgaccatagcaggatccttaccgactagccgacaggacccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgtgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttgaaaaatacttttccttacctttaccccatccctgtctttactcctcacacttactgtaagacattagtaacataataaattaaaagtcacacgaatctcaccaacataa

SEQ ID NO: 285111 - DNA, 564 bp, Homo sapiens
ccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggtaagggccggggctgggcgtggggaggggtgccctgccctcttccgcgcgtaccc

SEQ ID NO: 285112 - DNA, 384 bp, Homo sapiens
ttactttaggtaaccctgcctgagcagctcctgcattgctacaaggatgaagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaag

SEQ ID NO: 285113 - DNA, 2003 bp, Homo sapiens
tacttctcttcatttcccaaaaatgaagttagaaaaaaagcaatctattcaaatctggaaatggctgctggagggctctgggacgcattcatccaacatgcaattcatcactgctcaccagagctggcaggcgacaggtcattccggggcgctttcaaagagcgcatgtagagatacacactcaagaccacacaaaaaacagtggccgcaagtgcaaactgaagaaaatgactgtacacgtaatgaaactctacgccctggaagagagatgttccgatgactgcagatgtcaggataaaagcatagaatcctttaaaaaaaaaaaaaaaaggaagtggaaaattaatattaacccaaggctcacatgaaacttacgccactatgaaacaatgcaatgttcatttttaaagtcttaatttcattattcagactaaatacacacaaatatgcaaataagcaatgtctgaggtataattttcaatatacataccattatctcttgtagaactttccaaatagtttaacatattgattctttttcagttcaaatggtcattatttgcttttaattaagggaaaacagacaagaagtgcaacctgaaaattcccacaatccaaactctcaggcacaaagtcaaatggctaattattaacagagctgggccaaacacatattttaaagtctaatgccattacctaaggggagggtattatgcacctaccaggggtcaggcaccgagccaggttggtagttacaaaattataaatatttatacttaaccaagttgccaataatggtttcaaaagattctagtaaaactctatcatccagaacagagatcttaacatgccacccgcagaaaagatgccacaacacaaatgcccgaggctaggcaggggactgcgagtacctggggggtagggacagcaggcggggacattcacgtgcaatgccaagttaaaaagcacccgccctgtgacgctccacagaactctcgttccgggctagtcctgcagccacacagaaaggctcactggaagatccaatttttttcttttggctaaagaaatagttttgctttcaaaggagctgagtgcctcaaagagctgtgatcctaaaaagtcatcaaatccatttggataaacggtcaaaagcaaaaaagaggtagctgttatttatatgagaattctaaaaccaaaccttttgtaaagtaaaatagttgtctcaaattatctgaatccacattttccacaaatactccaaacaataacttctaaattctgacttttgaaaatattcatttacctttcataaaatgtaattttaaaaaagaatggttagataaagcagtcttttgctctctagcctatgtggattaaaaataatcatccaaaatgtcttaggaacctccttagttaataatcgtaaaatctcgaaaagaaatctcaatacttgaaccagagtaattagatgaggaaatttttaaaaaggatcaagcaacttggccagccactcccccactggctccaagagctccatgtccaagtgctgtgctcagtctctgaatgtaccacacccctcagagggaagtgaaaatataacacaagattacttagaaaagaattggtacctacagagaaacacacaaaacactgaaatcaaaggacctggcggcaaagtcaacaacccacctcaccccagactcaccttccctggtgtggtaagtgaaccaccagagggagggagggtgccaaaggttctaaaacttgctccatcagcaaagaatttggtaaaagcaacaaaaagtctaacaataccaatgataagtattaagcacccaccaggggtcagactctggagctgggggagacgttttatcacatgactggcactaaaaggcagaaggtgtctaaactatctttggcttcccctttagaacccagtggagtgactgcagacagagtagatgctgcgtaagtctctaaacaaagtatccaaagtt

SEQ ID NO: 285114 - DNA, 1184 bp, Homo sapiens
gggaggctgccatgagaggggcctccggcaggggaaacgtatggtcccaaaactgaagtcataggaaacaaatgcatttccaatgttatttgagaaaagcccaaagaccaagcagcaggcccagtgtcctttcctgctgagttttcctgggataggtcccccatcacaacctactccctggggctcccagggggattcgtggagaggcggcgcccaggggggccttcgtggaggaggtgccctgggtccgcctgcccacgcgcctggctcccccgcagactgtggcctggcgccggccgcgctcaccaggattgtgggcggcagcgcagcgggccgtggggagtggccgtggcaggtgagcctgtggctgcggcgccgggaacaccgttgcggggccgtgctggtggcagagaggtggctgctgtcggcggcgcactgcttcgacgtctacggggaccccaagcagtgggcggccttcctaggcacgccgttcctgagcggcgcggaggggcagctggagcgcgtggcgcgcatctacaagcacccgttctacaatctctacacgctcgactacgacgtggcgctgctggagctggcggggccggtgcgtcgcagccgcctggtgcgtcccatctgcctgcccgagcccgcgccgcgacccccggacggcacgcgctgcgtcatcaccggctggggctcggtgcgcgaaggaggctccatggcgcggcagctgcagaaggcggccgtgcgcctcctcagcgagcagacctgccgccgcttctacccagtgcagatcagcagccgcatgctgtgtgccggcttcccgcagggtggcgtggacagctgctcgggtgacgctgggggacccctggcctgcagggagccctctggacggtgggtgctaactggggtcactagctggggctatggctgtggccggccccacttcccaggtgtctatacccgggtggcagctgtgagaggctggataggacagcacatccaggagtgaccaccacgtgactgcccaggccgagactctacgtgaaagcaacaggagcagcaggccacccaacaccccaccccaccgtaccctacccaaggacgggtgtgggggggctgtgggtcatggggatgcattttggtaccaccctttgttccaataaacacagcccctccaccct

SEQ ID NO: 285115 - DNA, 538 bp, Homo sapiens
gggaggctgccatgagaggggcctccggcaggggaaacgtatggtcccaaaactgaagtcataggaaacaaatgcatttccaatgttatttgagaaaagcccaaagaccaagcagcaggcccagtgtcctttcctgctgagttttcctgggataggtcccccatcacaacctactccctggggctcccagggggattcgtggagaggcggcgcccaggggggccttcgtggaggaggtgccctgggtccgcctgcccacgcgcctggctcccccgcagactgtggcctggcgccggccgcgctcaccaggattgtgggcggcagcgcagcgggccgtggggagtggccgtggcaggtgagcctgtggctgcggcgccgggaacaccgttgcggggccgtgctggtggcagagaggtggctgctgtcggcggcgcactgcttcgacgtgtgagttccaaacgctccaaatgcccctacatgtctctgtagctcacccggaaccgaactgttgcccgaaaacgcaccctgaccccctcct

SEQ ID NO: 285116 - DNA, 2698 bp, Homo sapiens
  misc_feature (918)..(918): n is a, c, g, or t
gaattccgcgtgtggccgcctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggcatcatgctgggccgcatgggtgacagcggggnccccctggtcagcttctgccagtgcctcaatgagtcggtcatgaagatcgtggcggtggctgtgtggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgcggcatcctgcaggctctgctcatcgcgctggccacctcctccagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcagtatcacagccactgcagccagcattggggcagctggcatcccccaggccggcctcgtcaccatggtcatcgtgctcacctccgtgggactgcccaccgatgacatcaccctcatcattgccgttgactgggctctggaccgtttccgcaccatgattaacgtgctgggtgatgcgctggcagcggggatcatggcccatatatgtcggaaggattttgcccgggacacaggcaccgagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcgggatgaggagctgcccgctgcgagtctgaaccactgcaccatccagatcagcgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatctcagagaagggaaaggctgcatgggggagccccatccagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttcaat

SEQ ID NO: 285117 - DNA, 1324 bp, Homo sapiens
  misc_feature (802)..(802): n is a, c, g, or t
  misc_feature (849)..(849): n is a, c, g, or t
gaattccgcgtgtggccgcctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggcagaaagaagaaagttggaggaacggaccaaagggtcctggctgaatgggcacctccttaagagttttccaggaatcaccacccaacgacttccactcacctctcgatggccaccccattagcaagagaatcagagcttgatggcaggtcccatttggtccccacaacataataggacttctnttaaggaaggacgggagaatggagactgcataggcaactagctgtcnctgccaaggcccacatttaaaatgattgtaattgtaaaggaagttgtaaagaaatgtctatataggtataagttccatttggcttcttacgagcttccaaatgttctccgtgtgtgtaaactgagtcttgaaagaggggaagagggttaccgaggacaagagtgagtgggaggcgacccaggtggaggcagtgtgagtgtggggcggcaggttggaggaagagcaggcatgcaacggaagcctcttaccagatgctcacctcagagttggcatttctcacaagacacactcctagaaggggactgtgaagacaaagatacaaatgcttttagagaaaggttgctgccaggaccatgtgagggtgcccatctcaccaaacctcccacattgtgcactgtcatttgaaaaatactttgtcagtttgacaggtggaaatatcttgaatttgttgatgaaactaaacattttaaaaagc

SEQ ID NO: 285118 - DNA, 545 bp, Homo sapiens
  misc_feature (36)..(37): n is a, c, g, or t
aacacaaggtgttgctgggtgctctgattatccccnngcagaatacactcaaagaagggaaaggctgcatgggggagccccatccagggagtgatgggcccggcattgcctgaggccccgctgtgacagtttccccggtgtgagcccggtgagggcggcaggcaggggttatccggccccactttctggatgacagacttgaggctctgagagctgaaaacacttgtccttgtgtcttctccagggaacggacggacagatggacagggcagacggcgagctgctatggctgattctggctggggcaagaactgtctgtggcataggctttggagggctgttcgcacatgacttgtgcatgtgtgtgtgtgtggtgtgtatgcatacgcatacacatgtcagcagggggagggaatgggtgcctgtgtgtgccagggcaggggcagacccttccctgcatgattcagagggcgtggcagcggtagtgggggtgtgacagagactgtggtggtttggagggtagttgtgtgtggctgagctgggtg

SEQ ID NO: 285119 - DNA, 2526 bp, Homo sapiens
  misc_feature (918)..(918): n is a, c, g, or t
gaattccgcgtgtggccgcctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggcatcatgctgggccgcatgggtgacagcggggnccccctggtcagcttctgccagtgcctcaatgagtcggtcatgaagatcgtggcggtggctgtgtggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgcggcatcctgcaggctctgctcatcgcgctggccacctcctccagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcagtatcacagccactgcagccagcattggggcagctggcatcccccaggccggcctcgtcaccatggtcatcgtgctcacctccgtgggactgcccaccgatgacatcaccctcatcattgccgttgactgggctctggaccgtttccgcaccatgattaacgtgctgggtgatgcgctggcagcggggatcatggcccatatatgtcggaaggattttgcccgggacacaggcaccgagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcgggatgaggagctgcccgctgcgagtctgaaccactgcaccatccagatcagcgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatctcagagaagggaaaggctgcatgggggagccccatccagggagtgatgggcccggcattgcctgaggccccgctgtgacagtttccccggtgtgagcccggtgagggcggcaggcaggggttatccggccccactttctggatgacagacttgaggctctgagagctgaaaacacttgtccttgtgtcttctccagggaacggacggacagatggacagggcagacggcgagctgctatggctgattctggctggggcaagaactgtctgtggcataggctttggagggctgttcgcacatgacttgtgcatgtgtgtgtgtgtggtgtgtatgcatacgcatacacatgtcagcagggggagggaatgggtgcctgtgtgtgccagggcaggggcagacccttccctgcatgattcagagggcgtggcagcggtagtgggggtgtgacagagactgtggtggtttggagggtagttgtgtgtggctgagctgggtg

SEQ ID NO: 285120 - DNA, 1611 bp, Homo sapiens
gccggagcagcgctgcagaggcacaaacactcctggcggggtggctgcctggggaggggtgagcttcccgacagaggccccagccatcctggaggagggtgctgggcagacaccggcccctctaaccgtagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcagtatcacagccactgcagccagcattggggcagctggcatcccccaggccggcctcgtcaccatggtcatcgtgctcacctccgtgggactgcccaccgatgacatcaccctcatcattgccgttgactgggctctggaccgtttccgcaccatgattaacgtgctgggtgatgcgctggcagcggggatcatggcccatatatgtcggaaggattttgcccgggacacaggcaccgagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcgggatgaggagctgcccgctgcgagtctgaaccactgcaccatccagatcagcgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatctcagagaagggaaaggctgcatgggggagccccatccagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttcaat

SEQ ID NO: 285121 - DNA, 815 bp, Homo sapiens
tacatttaagacatatttttgtgtttcttaatgaataaattatgaaagaatgttaatttaaaattcataatatgtaaaagaatatttagatttcatttcctataatcagacacgctgttgtttttactatataactgttagaagatataaatctataacatatgcagcatatacataaaaataatcacaatatttttaaaagtttctgttaatgtcatgtatcttctttttttatccaaaagaaaacttattcaaaaaaatgtacccagaagacacagcctaaggaatacaagcaggaaactgagaaacctgccaacaacagctaaagggacacaaacaggtacatgcaaagttgccagtaagcagcatttaaaatgctgattttcagaaagagagcagcaggtggagttaagggtttaggctctggcgtcagactacttagggacgttgggaaagtttcttaccctctctgtaccacagttttctcatttgtaaaatgggaaccaatccttctttgcttttttttttttttgagacggagtcttgctcggttgcccagccttgagtgcagtggcgcaatctcaactcgctgcaacctccgcctcccgggttcaatggaatccagcaaaagaaaattcgaagaattaaggatgctattatatggtcctgtctatcagtggggaaaatacctctgaacaaaactagaaatctcttcagtggtaaaaaccatatgctccctagaaggctgcaatcatcagcacagtttaccatcacataagcataagtcactggacaatctgataccctaaaggtgg

SEQ ID NO: 285122 - DNA, 1664 bp, Homo sapiens
cggccttcctgcagcggggggacaaagagggcggcgggcggctggcggccttgagcgcagcccggtcggcagtgcagggcctgcgaagcccgcgggccggcgcaggggtgggagtcgggcccggggcccagagagaccttccggggccggggctgcggctccgcgggcttccccaccggccgggtctcccggcaactaccagagagcgggggcgcccggggaggcccggcgttccacaaggtccacgcgtattcgcgggccgcggggtcgccgccggccgcccaggcgcggagcctctcgggggtcacccggccgccgggcccgcgggacgcacggggcctgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggatgaacacgcagggttccggaccaatacctgggccattgtgactctcagaatgccaggcaataagagatcagaaagctggttccacttcatcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacacca

SEQ ID NO: 285123 - DNA, 1872 bp, Homo sapiens
cggccttcctgcagcggggggacaaagagggcggcgggcggctggcggccttgagcgcagcccggtcggcagtgcagggcctgcgaagcccgcgggccggcgcaggggtgggagtcgggcccggggcccagagagaccttccggggccggggctgcggctccgcgggcttccccaccggccgggtctcccggcaactaccagagagcgggggcgcccggggaggcccggcgttccacaaggtccacgcgtattcgcgggccgcggggtcgccgccggccgcccaggcgcggagcctctcgggggtcacccggccgccgggcccgcgggacgcacggggcctgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggatgaacacgcagggttccggaccaatacctgggccattgtgactctcagaatgccaggcaataagagatcagaaagctggttccacttcatcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacagtcaaatctcatgagaccagcaggatgaacaggtaacagaggtcaaagagaaagaatgaatgcccacctatggatggaggcagtttagagaaatatgcttgtccaaagtcacaattaactgcactgacacagagaagcagatattgcacttttgctcaactaaataccactttgatgactaagaacgggccctctgggatcagacaaaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacacca

SEQ ID NO: 285124 - DNA, 1494 bp, Homo sapiens
cggccttcctgcagcggggggacaaagagggcggcgggcggctggcggccttgagcgcagcccggtcggcagtgcagggcctgcgaagcccgcgggccggcgcaggggtgggagtcgggcccggggcccagagagaccttccggggccggggctgcggctccgcgggcttccccaccggccgggtctcccggcaactaccagagagcgggggcgcccggggaggcccggcgttccacaaggtccacgcgtattcgcgggccgcggggtcgccgccggccgcccaggcgcggagcctctcgggggtcacccggccgccgggcccgcgggacgcacggggcctgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacagtcaaatctcatgagaccagcaggatgaacaggtaacagaggtcaaagagaaagaatgaatgcccacctatggatggaggcagtttagagaaatatgcttgtccaaagtcacaattaactgcactgacacagagaagcagatattgcacttttgctcaactaaataccactttgatgactaagaacgggccctctgggatcagacaaaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacacca

SEQ ID NO: 285125 - DNA, 1579 bp, Homo sapiens
cggccttcctgcagcggggggacaaagagggcggcgggcggctggcggccttgagcgcagcccggtcggcagtgcagggcctgcgaagcccgcgggccggcgcaggggtgggagtcgggcccggggcccagagagaccttccggggccggggctgcggctccgcgggcttccccaccggccgggtctcccggcaactaccagagagcgggggcgcccggggaggcccggcgttccacaaggtccacgcgtattcgcgggccgcggggtcgccgccggccgcccaggcgcggagcctctcgggggtcacccggccgccgggcccgcgggacgcacggggcctgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggatgaacacgcagggttccggaccaatacctgggccattgtgactctcagaatgccaggcaataagagatcagaaagctggttccacttcatcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagagaagttttgttcacattctttggaatcagaagtggaattcaagcaacactgattcttctcctgatgctgtcctgaaccaacacattgggatcttcaagggtcctttgagttcagttgtcttctcagagatgccaggaagcctcaggtgtatgcatgtctgttcgtatgttgtctacataataccaagttgacttcgtttgttcgttcgtgtgtttttgttgagctaccgggcctggccccacattgacttttaaataaatgtgagtattcataaattaag

SEQ ID NO: 285126 - DNA, 991 bp, Homo sapiens
  misc_feature (673)..(673): n is a, c, g, or t
  misc_feature (682)..(682): n is a, c, g, or t
  misc_feature (701)..(701): n is a, c, g, or t
  misc_feature (704)..(704): n is a, c, g, or t
  misc_feature (711)..(713): n is a, c, g, or t
  misc_feature (719)..(719): n is a, c, g, or t
  misc_feature (728)..(728): n is a, c, g, or t
  misc_feature (732)..(732): n is a, c, g, or t
  misc_feature (735)..(735): n is a, c, g, or t
  misc_feature (747)..(747): n is a, c, g, or t
  misc_feature (751)..(751): n is a, c, g, or t
  misc_feature (755)..(755): n is a, c, g, or t
  misc_feature (759)..(759): n is a, c, g, or t
  misc_feature (769)..(770): n is a, c, g, or t
  misc_feature (776)..(777): n is a, c, g, or t
  misc_feature (781)..(782): n is a, c, g, or t
  misc_feature (790)..(790): n is a, c, g, or t
  misc_feature (803)..(803): n is a, c, g, or t
  misc_feature (811)..(811): n is a, c, g, or t
  misc_feature (818)..(818): n is a, c, g, or t
  misc_feature (822)..(822): n is a, c, g, or t
  misc_feature (831)..(831): n is a, c, g, or t
cagtactcctaacggtttaaggtagcgaggctgggtggcgcctggatcatggctgccgcgccgccgctacgggaccgcctgagctttctacaccggctcccgattctcctgaaggggacgtccgatgatgatgtcccgtgtccgggctacctgtttgaagagattgctagtatccttccttgatgtccccgtgtagtggaaagagcggatggcagggtcccagagtggtgcaaagggttcctggggattctgctgtccctagggggatgcacggctcctttattattgtaaccaggcatgggtggggtctgaaggctgcaatactgatgacacaggggaccctagaagcccaggtgctcctgatggcagagcctccagtaggcgcctccagggagcgtgaactgagaggccccatggcctggtctccctgcggcctggcgcagccctcatcatctcgcccttccctaacccgagcgtgccgcagaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagctntgcagggcncccagatctctgacggganagntgtaacnnnaaggtncggcggcgngcangantggggagacacnggcncganacgngttgcgtggnncctccnnactnngggacccngctgcaaaggcanggtccggncaggcgncagnactcaggtncggaacgaagaccggcgcgctgtgggacagccggaggagaggtaggaggatggagagcccagcaacccccaaagacccgaagggagcgccgcacacgagaacacaggacgagcagcagagggaaagggggacaacgagaaaggccaacagcacaggacaa

SEQ ID NO: 285127 - DNA, 4321 bp, Homo sapiens
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccaggacgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctagtatccttccttgatgtccccgtgtagtggaaagagcggatggcagggtcccagagtggtgcaaagggttcctggggattctgctgtccctagggggatgcacggctcctttattattgtaaccaggcatgggtggggtctgaaggctgcaatactgatgacacaggggaccctagaagcccaggtgctcctgatggcagagcctccagtaggcgcctccagggagcgtgaactgagaggccccatggcctggtctccctgcggcctggcgcagccctcatcatctcgcccttccctaacccgagcgtgccgcagaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgtgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 285128 - DNA, 3915 bp, Homo sapiens
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccaggacgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagagctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgtgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 285129 - DNA, 4006 bp, Homo sapiens
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccaggacgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgtgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 285130 - DNA, 3457 bp, Homo sapiens
gtgactctacaggatcctcccgctctcacccaccccgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctagtatccttccttgatgtccccgtgtagtggaaagagcggatggcagggtcccagagtggtgcaaagggttcctggggattctgctgtccctagggggatgcacggctcctttattattgtaaccaggcatgggtggggtctgaaggctgcaatactgatgacacaggggaccctagaagcccaggtgctcctgatggcagagcctccagtaggcgcctccagggagcgtgaactgagaggccccatggcctggtctccctgcggcctggcgcagccctcatcatctcgcccttccctaacccgagcgtgccgcagaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgtgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 285131 - DNA, 3069 bp, Homo sapiens
cagtactcctaacggtttaaggtagcgaggctgggtggcgcctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgctgttcatccctgactgttgagagaggaccctgctgcagcctccctgtggccagtagcacagttctcatcccttcccagtcctctctccggccatgtcaacagtgagagctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgtgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 285132 - DNA, 2531 bp, Homo sapiens
ggtggggctaggtggagctttcaggctgtgataagaacgctggtttctccctccaggccccggaagcctctgaggggtccctggtgcacctggggcagggagagtgggcttcggggaggccacacccgctcaggcaccaggggttgccgaccctgggggagacgaggtggttgctgtggagagagtctcgcctctgtggggcatgggtgagggggagctgagggtctgctcaggtgtggcctctgcagggtcctggaggagggcatcccattggctgtgacagaagggccttggtggcaggaacttgccaccctggagtgggcccagggcaccgtgctccacagggagcagcggtgccaggctcagccctgcccccgacttgccttttctgttctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgtgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 285133 - DNA, 2283 bp, Homo sapiens
cagtactcctaacggtttaaggtagcgaggctgggtggcgcctggatcatggctgccgcgccgccgctacgggaccgcctgagctttctacaccggctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacggctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgtgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 285134 - DNA, 1794 bp, Homo sapiens
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccaggacgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctaaaatctcccacgagtctccgggcagcagccagtgcctgctggagtacctcctgagccgtggctgcacagatagagcaggatcttcagcaccttgagcttccgtcga

SEQ ID NO: 285135 - DNA, 2957 bp, Homo sapiens
cagtactcctaacggtttaaggtagcgaggctgggtggcgcctggatcatggctgccgcgccgccgctacgggaccgcctgagctttctacaccggctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgctgttcatccctgactgttgagagaggaccctgctgcagcctccctgtggccagtagcacagttctcatcccttcccagtcctctctccggccatgtcaacagtgagagctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgtgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 285136 - DNA, 2959 bp, Homo sapiens
cagtactcctaacggtttaaggtagcgaggctgggtggcgcctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacgggctcggcaggcgaagccttcctctccaccatccagaaggccgcagaggtggtggccagcgccatgcgccccgggcccgagagtcccagtacccggaggctcctgccgcggggtgacacctaccagcctgccatgatgccttcagccagccacggtcccccaaccctggggaacctactccccggggccattccaggtccccgagctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgtgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 285137 - DNA, 2101 bp, Homo sapiens
ggcctggcggaagcggggcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgtaagcccctcttagtaaaccctctgagaagtagaggccggggcgagttcccaggtgtcgtcctgagcaaactgccctcttttgtcagccctgagctttcctgggctggacctcagagggggctgggtggtcccaggacgcgaccttgggctgccagaagccacgctagggttggtcaaggctctcagtgcaaggtttcgacatagtcgttctgtgctgcgttctgcagttgtcagctgtcacctgcaaacctcagcagctccccttagggcgtggtgggcaaacagtgtcagtgatgcgtgtccacagcctcgggaaacacttcaggtccacgttttcgtatgttgtcactagatctcggcccttccgaccgaaaggcttcggcacctcacgcggtgggtcccatgcttgtcctgttaaatactcttgaactctattctgtcctgatactgaataatgcaagaatgggtggttccagttttcatccctataaaccgtacatctttgtgccagtaagtaagcatgaaacaaataagtacgtctgcgctaagcgaacgtaaaacacacgacatcagtcggttctcggggagcgatggagctagtcacgctgagcggctgtcactctgccattccggcctctggggaggtggaacgattcatagtcccctgtgtggaaaaggggcttgcctgggccttgtttggctttgctagtcagtaggtaggtacaggagaggtaccttcaaatagccttacatgctggtaagtgcagggaggctgggggctgtgtcccttcttaacccaagtggcgcagctcctccgtggagaaccaccattgatttgcctcttctccgaggctgttcatccctgactgttgagagaggaccctgctgcagcctccctgtggccagtagcacagttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgagcccctgggtggtcaagggtcaggcctgaggcccggcccacggtggtgaggatggaggagcagacgagcggcccagggtggcaggcagctctgtgcccttggggtgcccccgggccctgccctgggtgtcccgtgtccggcctgcccagcactgctgaccgccccactccccaggtgctgaagatcctgctctatctgtgcagccacggctcctccttcttcctgctcatcctcaaacgcaactctgccttcatccaggaagctgcaggtacaggggccgcgcacgcgctcaggaagagccagggctttggagaatg

SEQ ID NO: 285138 - DNA, 787 bp, Homo sapiens
gggcgctgggctgggctgcatccagcccccctggaaagcaggattgctcagcagtgaagggttctagagcttgcctgtctggcttcacatcttggccatcatagttaaactgtgtgatcttggacaagtcccctaacttctaagtgcctcagagaccaaagaccaagggtactagtgctatatctttgagaaggatactataagaatgataataggaggtaccatgtggagtgtagtgaggattaaatgagctagtccacgtgaaacacttggcatgagaagcctgccatacaagaagccctcagtgaacaccagccattacagtggctaccgtgagagcagatgacgggggaaagagtcagggctctgaaacttacactggattcttgtttgtttcagggtctcggattgcgagctggctgccgagtttttcggttgaagtgatgcacaccaccaacattcttggcattacgcaggccagcaactcccagctcaatgcaatggtaaggtctgctagctgctttaagaagatcactgggaattaggagggaaagaacagctagagcgtgtgtgccgggtatatgaccttgttggtcttactctgctctggcagagtggaaggatttttaggggcttctttttatttactgggaccatttacattcctgtgttttaaattttgaaacgttcattttatttctgtggcggataatctaaccttttctgaacactactaggttcactctgttgtgatctaggcctaccttgggactccttcgattttagc

SEQ ID NO: 285139 - DNA, 160 bp, Homo sapiens
gggctcggtccccatcctttcctttttcacgttacacgaaatggcagaaattttgaaacgttcattttatttctgtggcggataatctaaccttttctgaacactactaggttcactctgttgtgatctaggcctaccttgggactccttcgattttagc

SEQ ID NO: 285140 - DNA, 3591 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttactctttgaaagctttgttttgtggtagtccttttgggaagaatccagtattatctacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgattttttttttttaatttgttttgctgagagcatagctatttgtttttattgtaaaacaataataataataaaaagcaaactctaattggtgtgttgtg

SEQ ID NO: 285141 - DNA, 3079 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttt

SEQ ID NO: 285142 - DNA, 3400 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaaggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttactctttgaaagctttgttttgtggtagtccttttgggaagaatccagtattatctacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgattttttttttttaatttgttttgctgagagcatagctatttgtttttattgtaaaacaataataataataaaaagcaaactctaattggtgtgttgtg

SEQ ID NO: 285143 - DNA, 3057 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctcccaggataaaagatacaaaagttctttttatttctttaataaagcccttcaaggtttactctcccagtcgatccggccgcgaatttagtagtagtagtcgacc

SEQ ID NO: 285144 - DNA, 2855 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttt

SEQ ID NO: 285145 - DNA, 2729 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggagggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttt

SEQ ID NO: 285146 - DNA, 2361 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaagggttgatggatgcgtgataagatgggctataggttggaggcgtaataactttggaaatttaggaatttttccctaaaatgaattaaggggagacaggggaggagggggggaaaaggagagaagtgtggaggaaaagagggaac

SEQ ID NO: 285147 - DNA, 879 bp, Homo sapiens
aatcagctcgcgtaccgttaacatctcgcgcacacatctcatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttactctttgaaagctttgttttgtggtagtccttttgggaagaatccagtattatctacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgattttttttttttaatttgttttgctgagagcatagctatttgtttttattgtaaaacaataataataataaaaagcaaactctaattggtgtgttgtg

SEQ ID NO: 285148 - DNA, 1768 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaatcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttactctttgaaagctttgttttgtggtagtccttttgggaagaatccagtattatctacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgattttttttttttaatttgttttgctgagagcatagctatttgtttttattgtaaaacaataataataataaaaagcaaactctaattggtgtgttgtg

SEQ ID NO: 285149 - DNA, 1670 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaaggtctcggattgcgagctggctgccgagtttttcggttgaagtgatgcacaccaccaacattcttggcattacgcaggccagcaactcccagctcaatgcaatggtaaggtctgctagctgctttaagaagatcactgggaattaggagggaaagaacagctagagcgtgtgtgccgggtatatgaccttgttggtcttactctgctctggcagagtggaaggatttttaggggcttctttttatttactgggaccatttacattcctgtgttttaaattttgaaacgttcattttatttctgtggcggataatctaaccttttctgaacactactaggttcactctgttgtgatctaggcctaccttgggactccttcgattttagc

SEQ ID NO: 285150 - DNA, 1575 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttggtaagtttcctcagaaggagctctaacagagggcaagcctttcagaatcaggaacagtaatggttcttcagttaaaaaatgaaactttagaaataagatgtggatggactacttaaagactaaaaatgaatgtggctgcaaaccctccctctttttgccactgggtgtaaggcagtgccatggaactgctttggctggtgcctaactcaggaggtgtttgctgtcctgggagacttagttaactctgctgaccaagtcaatagattattcttttagcatgaaattaaggagctgcctttccccatagtttctatggctttaaatatttagcaggtactttgtaggtggtaatgggaattcctgcagtgttagctacttcacagatttatacattttccatctttgtaattaaaaaaagtctttacacttaattcctacattcctactaccatcattgtttacattttactttggtatgttagacgttacggtgtcgtagatctgcttcattggttggcccttcagtgatctaataatg

SEQ ID NO: 285151 - DNA, 252 bp, Homo sapiens
accaaattcagtagtaacagtaaattactaaggtgttttctctcttcattacagatacgtaattcacctctgggacctcaaccacgaagggacgtgggaaggaaaggggacgtatgtctattacacagactttgtcatggagctcactctcctgtccctggacctcatgcaccatattcacatgttggtaagtttcctcagaaggagctctaacagagggcaagcctttcagaatcaggaacagtaatggtt

SEQ ID NO: 285152 - DNA, 3227 bp, Homo sapiens
ggcctaggggcccctccgccagggacccccgagggcgagcgcctggggggcgcggccttgctcgcgggagcgctgctgagggagagtggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttactctttgaaagctttgttttgtggtagtccttttgggaagaatccagtattatctacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgattttttttttttaatttgttttgctgagagcatagctatttgtttttattgtaaaacaataataataataaaaagcaaactctaattggtgtgttgtg

SEQ ID NO: 285153 - DNA, 3687 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatggagatgacagctccatgcgtgttactgcccctgaagacgttccagtgggacaggaggtggaggtggtcgacagtgatactgatgctcctgacctgtggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttactctttgaaagctttgttttgtggtagtccttttgggaagaatccagtattatctacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgattttttttttttaatttgttttgctgagagcatagctatttgtttttattgtaaaacaataataataataaaaagcaaactctaattggtgtgttgtg

SEQ ID NO: 285154 - DNA, 2713 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgtaaagcctgtgggtttggtccttgaacaagatgtgggccttgcaagatgggagagtaaaccttgaagggctttattaaagaaataaaaaagaacttttgtatcttttatcctgggagcactgcgttt

SEQ ID NO: 285155 - DNA, 2363 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgctgtctacctgtccacctgcaaggattcaaagaagaaagcagagtgagggcactcactgccatcctgtggaagccacatcagcct

SEQ ID NO: 285156 - DNA, 614 bp, Homo sapiens
cgagctcggtaccctgcacacgccgaggccccgacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttt

SEQ ID NO: 285157 - DNA, 1957 bp, Homo sapiens
caggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatggagatgacagctccatgcgtgttactgcccctgaagacgttccagtgggacaggaggtggaggtggtcgacagtgatactgatgctcctgacctgtggtctcggattgcgagctggctgccgagtttttcggttgaagtgatgcacaccaccaacattcttggcattacgcaggccagcaactcccagctcaatgcaatggtaaggtctgctagctgctttaagaagatcactgggaattaggagggaaagaacagctagagcgtgtgtgccgggtatatgaccttgttggtcttactctgctctggcagagtggaaggatttttaggggcttctttttatttactgggaccatttacattcctgtgttttaaattttgaaacgttcattttatttctgtggcggataatctaaccttttctgaacactactaggttcactctgttgtgatctaggcctaccttgggactccttcgattttagc

SEQ ID NO: 285158 - DNA, 1221 bp, Homo sapiens
acaggggacacccactcctgccaccttgggagcggttgccagacagagccgcactgggtgctggtgtcatccagggaccccacacacttccttaaatgtgatcctgcttccctctgggcagctgcatcctctcctcctgcaggaccgtctggaaacttggctctcagtttgatctcccttctctcctctgcctgccccaagcccctctttctaaaaaagtgatggaatattcatggggttatttcttgaaaatacttggcggcctccatgcttctgttttctttgagccaggtggtcaggagggtttacaaagaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattaggtatctggatctgttcggaaaaaaattagaaactatgtataaaacttaaaaatattcaagtatcaaaaggttatttaggatgaaagttttaaaacaagtcatcagcaagctgctgccaccaagtggagacttatacaaaagatgagcgagtccactgagctgagaggacagaaatgaagtcacctgtgctggggcaggggcagggacactgggggcagggagtgtgtgggcagagaagccagagaagtccaggcctgtggaagccaaacaggagagcgtgggccggaagggcggtcaggatcgggggacgaggtcgctctccctggagaacgaaccctaaagtgcgtagcctgggattccctccctgggggtcctgtcccccgacatttcacaggccttctgagctgccttccaaggaggactaacacggcaacaaaagacccatttctgcacaaaaatccttctggaaagaaaaagaagaaagccaagaatggagtcaaaacgctacccagtgctgaccaagcctctcaaaccctgttagaagtggagtgtggtttctaagtcagggaaatggaagaggccccacccacacagggacagggccacggcccccacaggatgaagcagcagcgtttattcaagatacaacagtgagggaatccagtcacg

SEQ ID NO: 285159 - DNA, 1323 bp, Homo sapiens
acaggggacacccactcctgccaccttgggagcggttgccagacagagccgcactgggtgctggtgtcatccagggaccccacacacttccttaaatgtgatcctgcttccctctgggcagctgcatcctctcctcctgcaggaccgtctggaaacttggctctcagtttgatctcccttctctcctctgcctgccccaagcccctctttctaaaaaagtgatggaatattcatggggttatttcttgaaaatacttggcggcctccatgcttctgttttctttgagccaggtggtcaggagggtttacaaagaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattaggctggagtacagtggctccatcatggatcactgcagcctctaactcctgggctcaagcaatcctcctgtgtcagcctcccagatacctaggattacagatggaccgaagcagagggtgctgtttcaacgccaccaccaggagagaggcagaggggctgtgccgtgctagagtcctcagggagggagtgacctcgaccctggctgtgctgcaagctgactccagccttggggtcagcagcacccggcgaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacacagagaccccctcgtcgtcctggacaccacaggggcacctgcaggctgggagaccaggtcctctgtgcatgggcccgggaggcagacctgccctaagggtgatgcagaggccacaggtgctgcacgcaccagcacccgctctagacatcagcctccaggttgactaagggtcaggtcatgtttgaaaccatgcttggctggaccaggacccatggcaagagcacccaggcaccctccttcagccctggtctgcaggaaggaggacagcagactttaggaccccatagcacagcagtgctgactatttcagcctcttggtctccttgaggagtagggatggggag

SEQ ID NO: 285160 - DNA, 867 bp, Homo sapiens
gtttgctacattgcccagactggtctcaaacacctgggttcagttgtcctgcctcggcctcccaaagtgctgggattacaggcatgagccaccacacccgaacacttggggtggttttaagcccccagcaaggtgcaccagcaggaccaggaggtggcctgggcaccccctatcactcccatccatgcaaacctagggaccgaagcagagggtgctgtttcaacgccaccaccaggagagaggcagaggggctgtgccgtgctagagtcctcagggagggagtgacctcgaccctggctgtgctgcaagctgactccagccttggggtcagcagcacccggcgaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacacagagaccccctcgtcgtcctggacaccacaggggcacctgcaggctgggagaccaggtcctctgtgcatgggcccgggaggcagacctgccctaagggtgatgcagaggccacaggtgctgcacgcaccagcacccgctctagacatcagcctccaggttgactaagggtcaggtcatgtttgaaaccatgcttggctggaccaggacccatggcaagagcacccaggcaccctccttcagccctggtctgcaggaaggaggacagcagactttaggaccccatagcacagcagtgctgactatttcagcctcttggtctccttgaggagtagggatggggag

SEQ ID NO: 285161 - DNA, 558 bp, Homo sapiens
cactttctccaggccgggccgggcttggtaaacctcagccgtgcctgggtagaggacgccgggctgggccgagcgggggtggaatgagggcgtctagaacagagaaaactaagatggggtcgtccccccagtaatctggaaaacagttacagcaacaggctcctctcatcagacggcagtgctggtcgtttcctcactggtttgcggggaaggctgggcagaaaaaggatgcaaccttgttctcaaccacttgctatctcgtgattcagggattggatgagtctctatggtttgttttgccctgaagagcagaaggcttctgtcccaactggtgttgccaaagcaacatattaattccatgccatgatcctgggtcaagatctgcacaatctgattgggcatgtcacctcggatggcaagggagtggaagtggtcaaaatcatggagtcccagctttcggagacgccttgcagctgcccggtgaagaaaatgcacaatggaaaccacccagatgtccagtgatagtggcatggacaaataaatgtggtataatcatga

SEQ ID NO: 285162 - DNA, 682 bp, Homo sapiens
cactttctccaggccgggccgggcttggtaaacctcagccgtgcctgggtagaggacgccgggctgggccgagcgggggtggaatgagggcgtctagaacagagaaaactaagatggggtcgtccccccagtaatctggaaaacagttacagcaacaggctcctctcatcagacggcagtgctggtcgtttcctcactggtttgcggggaaggctgggcagaaaaaggatgcaaccttgttctcaaccacttgctatctcgtgattcagggattggatgagtctctatggtttgttttgccctgaagagcagaaggcttctgtcccaactggtgttgccaaagcaacatattaattccatgccatgatcctgggtcaagatctgcacaatctgattgggcatgtcacctcggatggcaagggagtggaagtggtcaaaatcatggagtcccagctttcggagacgccttgcagctgcccggtaacacttccagggttggggctccacaaggaggtagtggcagagggaggaaagatgggccaggaactcccataggccatggtctccatgattcagatgaatccacatggttattgacatgcagaagccaatgtcaaaaactgaacgtccaaattggcttaagaaagagctcaagagaaccttccgggtcctttgattcatg

SEQ ID NO: 285163 - DNA, 2829 bp, Homo sapiens
catgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285164 - DNA, 2797 bp, Homo sapiens
catgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagagggggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285165 - DNA, 2361 bp, Homo sapiens
catgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285166 - DNA, 2691 bp, Homo sapiens
tagggcgatcgcgaccgcgcgccgcggacgctggggagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285167 - DNA, 2662 bp, Homo sapiens
gccttcacagcaccggaagagtcgctaggtggctgaagaggagggggctggggcaggaggtcaaagaacagagaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285168 - DNA, 2238 bp, Homo sapiens
cacaccacctgagtccacacagagctgaaggggttgggagatgtctcccaactgctgattaatgctgagtttctcaaaattaacttttgttcctttggcttaaagctctggccccagctgggccctcctgctgctcagcagtgcttccatgcattctcaatcaacatttgctggcccctaccctttgggtctatttattgagtgcttactatgtaccacgtaccatgatgagtgaataacacattatctcatttaatcctcttggttctacatttaataataggtcctagtatcctaattttacacagaaggagaaaccaaggttcagagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285169 - DNA, 1972 bp, Homo sapiens
ctgctcaccagccgcagccagcggcccagctgcaccgcaccaccaactttttcatcgacaacatcctgaggccggacttcggctgcaaaaaggagcagccgccaccgcagcttctggtggctgcggcggccagagaaggcgcaggaggaggaggctgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285170 - DNA, 2794 bp, Homo sapiens
caagaaagagacggttcaagggaattaccaggaggcgatgagccagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285171 - DNA, 2842 bp, Homo sapiens
tggctaggtacgaggccgggtgttaatcggccgaggccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285172 - DNA, 2736 bp, Homo sapiens
catgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285173 - DNA, 3081 bp, Homo sapiens
catgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatgttcgtatgaatgaagccagagaggccttagaatccatagcccattcccttctggcttctgagtctcctgacattgcttctccccttggtccttctgcacatctctccctggttccctgcccctgattgcctcccacaaagaaccattacaagacaagaggctgagctgtccatggtttacccaagtctctgcttgttttcttcctttgactctgcgtaaccctctctctgtccctctgttggtcccttcagctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285174 - DNA, 2703 bp, Homo sapiens
catgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285175 - DNA, 2941 bp, Homo sapiens
gccttcacagcaccggaagagtcgctaggtggctgaagaggagggggctggggcaggaggtcaaagaacagagaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285176 - DNA, 2976 bp, Homo sapiens
cgcggtgtggcgaggcccgagaagcgaagggagcatttaagactagtcgtaatttctcagtacccttttcagtctgggctttttcgctttctcgtactcggaatactgaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285177 - DNA, 2463 bp, Homo sapiens
catgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtga

SEQ ID NO: 285178 - DNA, 735 bp, Homo sapiens
cgcggtgtggcgaggcccgagaagcgaagggagcatttaagactagtcgtaatttctcagtacccttttcagtctgggctttttcgctttctcgtactcggaatactgaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctggtatgttccagagaactccctgtcccatatttgctctgtccttgtttcatcccactctgttttgggctcatggtctcctaaattccctgtcatgtggtttcatgggaaggaattcagtgccaagagagggaccctatttgccctttactcttagcatttgaaaatacca

SEQ ID NO: 285179 - DNA, 651 bp, Homo sapiens
ggggctccagtgagctatgatcatgccactgcactctagcttgggtgatagagtgagaccctatctcaagtaaataaatacaagttatttatttattgggtgagctgctcttttgagggatcactcagatatagatgaaactgcatttaacacagttcatgttcacttagatgaccacagctgggaagttaaatctactgtctgtcacttggatgttgatgtggctatagttagttcatgtttgttaaatgactacaactgggaaattatgtctactgtccttttgtacaagttcaaaagatgacagccacccatctaaaaatcctgaggcctatagaagatgcatgaggagtccctgtctccaggtttaccacttatgcttcttattaggatggcttgttatacatagcacttaatagtagtttcttctcttttctcttttgcatataggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtaaactaagacgtgtgtaagatctggaagtgataagaggtcttttct

SEQ ID NO: 285180 - DNA, 5404 bp, Homo sapiens
agatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccactctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtg

SEQ ID NO: 285181 - DNA, 656 bp, Homo sapiens
gacacaactgcacccactgactgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggtaacagtagggactttgagaatatgaagatgaatttttgaggactgacttaaatttcctaaaaaaaaaaaaaattaaaattctttagcctattctttagcctccattcctatctgtattgcatactgtaactccaacctttctatctttgttgctattctctcatgtataccacatgtacctat

SEQ ID NO: 285182 - DNA, 534 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacggtaaccggagggaattaaaaaacgggagagtctgttatgctgatgagtaacttttaagcaattatttttcttttctactttcagtactttggcgggggagattttggtattttattatatttaaaaaggt

SEQ ID NO: 285183 - DNA, 6234 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285184 - DNA, 4968 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285185 - DNA, 6366 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctgacctgatgatggtcctgtcttgttttattgaactaggacttgggtatgaaaactttcatgggctagtgagaccaggaaatcaactagcttttaaagcttgatttgtgtctaacaattgtagtgttagattagaggttgaagtacaaagccaaaaagctattaagagtttactttccaaagagttttgatagccctgcttgagatgatttttatctaaatagaaaagcctggctgcttgtcagcaacactttatttccctgttatgttcttatcctttggcattgagctagatacaaaccctactcttctctcttccttctggattggtccatttgtttatctcattcaataaatatttgccaagcacctcct

SEQ ID NO: 285186 - DNA, 5908 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285187 - DNA, 6210 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285188 - DNA, 5816 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285189 - DNA, 5932 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285190 - DNA, 5055 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285191 - DNA, 6027 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285192 - DNA, 6100 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285193 - DNA, 5802 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacgaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285194 - DNA, 5657 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285195 - DNA, 5041 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285196 - DNA, 4992 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285197 - DNA, 944 bp, Homo sapiens
gaaacagggtaaatggatttttatacatattataacctgttcctggttatatatggaaatacaaatagaggagctctcacttgacagtagaatccaggttttaatgaaaatgacatccaaggcctaggtatctgaacacaacaaggtctaaagggcacttgtcacattaagcaattccaagtcatattttaaattacttcctttcattcctaatattgccccttgctcttcttgtttttatgtattgggtatattttattttcctctcattcccatttttccttcaaatatttctgcagctctctccttcctgcttcctccttgctgtggtggctgggatgcttcttccatgattttttgaatctagactgggctgttctctgtgttaaaccaatcagttgcgaccttctcttaacaggtgtgtatggaaatatgtttattaagaaggaaaaatcttactttttaagaaatatgtatttttattcctttcatgtcatagcagaaaaaaatctttttaaataccttttttctttatgggttggtgagagggtgggaattggggagaatatttatttcaaaacctgtctttcaacattgtatattttggactggcataaagtctttcatagctataagagagaaaaaaacccattgagtccaacagagtatcactaatgcctgtaaaacctcctgtttatataatggtatggagaactcttcatttttatataactatcttttattgtatagatagcacacatagaccctctagatacttggatatttatcctgagttggaacaaataaaagggtaaaaagatagtctatttaaaacaagagtgtccaatcttttggcttccctgggctacagtggaagaagaattgtgttgggccatacataatgtacgctaaggatagccaatgagctaaaaaagaattgcaaa

SEQ ID NO: 285198 - DNA, 6589 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctgacctgatgatggtcctgtcttgttttattgaactaggacttgggtatgaaaactttcatgggctagtgagaccaggaaatcaactagcttttaaagcttgatttgtgtctaacaattgtagtgttagattagaggttgaagtacaaagccaaaaagctattaagagtttactttccaaagagttttgatagccctgcttgagatgatttttatctaaatagaaaagcctggctgcttgtcagcaacactttatttccctgttatgttcttatcctttggcattgagctagatacaaaccctactcttctctcttccttctggattggtccatttgtttatctcattcaataaatatttgccaagcacctcct

SEQ ID NO: 285199 - DNA, 6719 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatggtaaattctctttatatactgctatctgtctaaggctagttctattttgaagcctatgtgttttgtgaaacacaaaaaaaagtacagagaaagatcgcatccttttctggtaggggttttcaggaaaaagtaagagttctgactcatgttgggatttcttgggccgttattctgcagtggtcaaaatgggggaagcatgtctgtaaaagtgttactgatatgactaacactaactgatctactttcaaacattacctttttcctctccctccctgtttatgaatgttttgcccttctcttactattatatcttgttttgtttgagtttacaaattttcagagtttccctagctctggcacacactcatgaggttcctgtctctactcatactaacaaattgcatgtgttcacagcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285200 - DNA, 6155 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285201 - DNA, 6108 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttacctggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285202 - DNA, 3851 bp, Homo sapiens
ccaagagagatgtagagccgtcccgttttatttcattccgggcggcgttcgttgtagattactggtcctcggtctccaattacaatacagtggattccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285203 - DNA, 6048 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285204 - DNA, 5737 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgaaaaaaagagaaacaacaaaaaaagaaaaatatgtgggaggcagagggcccgggaaaaggttgttagaccacatggatggaggacagaggcaccaagagtggaacgtcgcaacgtggccaaagagggacccaaagaaacaccgggcacacaacaagggcagggattccccacaaataaaaagacccgggggagaacagagaaggcttgaaacacattcccaaagagtctcgaggacacagggatcaaacaagga

SEQ ID NO: 285205 - DNA, 3258 bp, Homo sapiens
tagacatgatacaatcgagctcgtacccagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285206 - DNA, 3001 bp, Homo sapiens
tgctattgacggggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285207 - DNA, 2702 bp, Homo sapiens
gaggatgcccccggatccatccctttgccctccattcgcctgccatgtggtgctcccaaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285208 - DNA, 6146 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagtcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttatatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285209 - DNA, 1690 bp, Homo sapiens
gccggctccgggtttactagaagatagaggacaacaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285210 - DNA, 1537 bp, Homo sapiens
gaggctgattagaggaccctcaggtgatggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285211 - DNA, 4113 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggaccctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtg

SEQ ID NO: 285212 - DNA, 2885 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggaacagaatgaagaaagtcagggggactgcaaaggccaatgttggtgctggcaaaaagaagtgagctggagattggatcacagccgaaggagtaaaggtgctgcaatgatgttagctgtggccactgtggatttttcgcaagaacattaataaactaaaaacttc

SEQ ID NO: 285213 - DNA, 2333 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggtaacagtagggactttgagaatatgaagatgaatttttgaggactgacttaaatttcctaaaaaaaaaaaaaattaaaattctttagcctattctttagcctccattcctatctgtattgcatactgtaactccaacctttctatctttgttgctattctctcatgtataccacatgtacctat

SEQ ID NO: 285214 - DNA, 2527 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaaggtcttggttcctgtttcttagtctttaatgtgggatagggaaaggaaggaacactttagcttaaggtacaaaatacttggcaacagtatgggagtctgcctggttat

SEQ ID NO: 285215 - DNA, 1049 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacaggtgtgtatggaaatatgtttattaagaaggaaaaatcttactttttaagaaatatgtatttttattcctttcatgtcatagcagaaaaaaatctttttaaataccttttttctttatgggttggtgagagggtgggaattggggagaatatttatttcaaaacctgtctttcaacattgtatattttggactggcataaagtctttcatagctataagagagaaaaaaacccattgagtccaacagagtatcactaatgcctgtaaaacctcctgtttatataatggtatggagaactcttcatttttatataactatcttttattgtatagatagcacacatagaccctctagatacttggatatttatcctgagttggaacaaataaaagggtaaaaagatagtctatttaaaacaagagtgtccaatcttttggcttccctgggctacagtggaagaagaattgtgttgggccatacataatgtacgctaaggatagccaatgagctaaaaaagaattgcaaa

SEQ ID NO: 285216 - DNA, 497 bp, Homo sapiens
gagaccctgtctgccagagttccaggcctgattttcaattttgaggaaagtgctaagactaaagagtgaatggttcttttatgagtactgacacaaggactccaggccacacatatcttcttgaaagcccttttcctgtttgaaaaaaagatcgtttgtatttgatagagcaaaagaaggccacaaaatgaattgtcttcttgtgggctgtgtttcagaacggccggtttgtgggcgatgctgaccttgaaagacagaaattttcagatttgaaactcaacggaccccaggtaattctttggctcaagacctgggttgcttcattcatattttcttatttccccagcctataagagcatatttgtgtcttgtaaggtgcctggcacattgtacatactcgtcaattagtttcttttatttacgaaaacaaagaagtggagctccaaagtatatatgcagttttgttttggaatgaattttaatgaccattgatcttt

SEQ ID NO: 285217 - DNA, 314 bp, Homo sapiens
tctctttgacgttcttcagacatattgtcttgaatgctcaagagccatctgatgaattgtctcttccaggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggtaacagtagggactttgagaatatgaagatgaatttttgaggactgacttaaatttccta

SEQ ID NO: 285218 - DNA, 5995 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285219 - DNA, 6137 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285220 - DNA, 6297 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaagataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285221 - DNA, 5751 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaataacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285222 - DNA, 5753 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285223 - DNA, 5729 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285224 - DNA, 6018 bp, Homo sapiens
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285225 - DNA, 6218 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285226 - DNA, 6551 bp, Homo sapiens
  misc_feature (6225)..(6226): n is a, c, g, or t
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctgaaaaaaannaaaaaaaaaaaaaaaaaaaaaaaaaaaaaagggggggggggtaaaaattccgggggggcccaaagtataacgcgatcaccaagtgtttttgtggtacagggggcgccataatagggagccggtaattaaataaacaaaggacgtgggggcgggtgtaacaaacggtccgcgtgtgagacaacgtgctacgccgggcaatcttggagaaggacccttaccttgggggtgcgactagtgtgcacatcctcaaaagaataaggcttaggaaataaattgtaggtatagtgtaccacgatatcgtcgaaaattgtcagaatgttcgaat

SEQ ID NO: 285227 - DNA, 6305 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285228 - DNA, 4541 bp, Homo sapiens
gacacaactgcacccactgactgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285229 - DNA, 6177 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatccttggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285230 - DNA, 5631 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285231 - DNA, 6175 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttatatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285232 - DNA, 6189 bp, Homo sapiens
tcctgtacctggtaaagtaagagggatccacccaggaacagcagggctgaaaccgatacgggccgttcaaacgctctgggggaaaaacaataccatgtacactgcaaagctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagtcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgccccaatctttagattaaaattatatagctgctcctga

SEQ ID NO: 285233 - DNA, 1566 bp, Homo sapiens
tgctcccttaggcagcgcctcctcaactgccctcagtttcccaatcaggtagtgagagtggcacgaaccagccgttctcctgagccaccccccgcgcccccggactcctcaatatcccaggtgggaacgctcaccagggacatccagcgcccgtcgccctgtacgtcctgcaccggcgtgggcttgctggctgggttctcctctccactcatcttggcgccgcagctcctgcaggatgagcgagtcgggtcggcccgggagtgttccgaacggagctggctccgccacgcccactcctacccctcgcggcaacaaaggaccgtcccaacgctagcacacccgcggaggacgaaggccgatacagggcgccgcctcctctccagggacggaagccttcacttaggaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctgaggctagggctggggacagatatcttgtactcccagtgacctcaataaagtacttttcatggtcctcttgatt

SEQ ID NO: 285234 - DNA, 1250 bp, Homo sapiens
ttcgagagctggggtcaccgcggaaaagaagccattgcgccccacagctacgtgaagtgggaagggccggggttcgttggggcgagagaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctgaggctagggctggggacagatatcttgtactcccagtgacctcaataaagtacttttcatggtcctcttgatt

SEQ ID NO: 285235 - DNA, 713 bp, Homo sapiens
agtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggtgagcgtccctcctgcccctgtactcccctttcctttgtcggctctagctcagctagcctctatgcttctttcctctgtgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctga

SEQ ID NO: 285236 - DNA, 1537 bp, Homo sapiens
ggcggagtttctgcatatggcaaggccaaggcatcttgtattggggctgacagggggcgggttattagggctgaggatgggaggatgctcagggtattggggtcagggtggcattagcccagctcaagccgggccgggctgactcagcatcctgccccagccagcttccatccctgacacctctgcactcccttgggcagagatgggagatggcgccggtgttgcccctggtgctgcccctgcagccccgcatccgcctggcacaagggctctggctcctctcctggctgctggcgctggctggtggcgtcatcctcctctgtagtgggcacctcctggtccagctaaggcaccttggcaccttcctggctccctcctgtcagttccctgtcctgccccaggctgccctggcagcgggcgcggtggctctgggcacaggactagtgggtgtaggagccagccgggcaagtctgaatgcagctctataccctccctggcgaggggtcctgggcccgctgctggtggctggcacggctggtgggggggggctcctggtcgtcgccctcgggctagccctggctttgcctgggagtctggatgaggcgctggaggagggcctggtgactgccttggctcactacaaggacacagaggtgcctgggcactgtcaggccaaaaggctggtggatgagctgcaactgaggtaccactgctgcgggcgccacgggtacaaggattggtttggggtccagtgggtcagcagccgttacctggatcccggtgaccgggatgtggctgaccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggctctggtgctccttggcctgcggtacctgcaaacagcactggaggggcttggaggggtcattgatgcgggaggagagacccagggctatctctttcccagtgggctgaaagatatgctgaaaacagcatggctacagggaggggttgcctgcaggccagcacctgaggaggccccaccaggagaagcacctcccaaggaggatctatctgaggcctagaggcctggagcttggggtgaggaagagggagggatggacaagtctgaaaacctcacaactccttaccaaggctccaggttggggggatcgtaggattagaggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaataaagtttttgga

SEQ ID NO: 285237 - DNA, 773 bp, Homo sapiens
gatagctgcagcgactctcttatttccaccgctcaccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggctctggtgctccttggcctgcggtacctgcaaacagcactggaggggcttggaggggtcattgatgcgggaggagagacccagggctatctctttcccagtgggctgaaagatatgctgaaaacagcatggctacagggaggggttgcctgcaggccagcacctgaggaggccccaccaggagaagcacctcccaaggaggatctatctgaggcctagaggcctggagcttggggtgaggaagagggagggatggacaagtctgaaaacctcacaactccttaccaaggctccaggttggggggatcgtaggattagaggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaataaagtttttgga

SEQ ID NO: 285238 - DNA, 439 bp, Homo sapiens
ggcggagtttctgcatatggcaaggccaaggcatcttgtattggggctgacagggggcgggttattagggctgaggatgggaggatgctcagggtattggggtcagggtggcattagcccagctcaagccgggccgggctgactcagcatcctgccccagccagcttccatccctgacacctctgcactcccttgggcagagatgggagatggcgccggtgttgcccctggtgctgcccctgcagccccgcatccgcctggcacaagggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaataaagtttttgga

SEQ ID NO: 285239 - DNA, 1441 bp, Homo sapiens
ggcggagtttctgcatatggcaaggccaaggcatcttgtattggggctgacagggggcgggttattagggctgaggatgggaggatgctcagggtattggggtcagggtggcattagcccagctcaagccgggccgggctgactcagcatcctgccccagccagcttccatccctgacacctctgcactcccttgggcagagatgggagatggcgccggtgttgcccctggtgctgcccctgcagccccgcatccgcctggcacaagggctctggctcctctcctggctgctggcgctggctggtggcgtcatcctcctctgtagtgggcacctcctggtccagctaaggcaccttggcaccttcctggctccctcctgtcagttccctgtcctgccccaggctgccctggcagcgggcgcggtggctctgggcacaggactagtgggtgtaggagccagccgggcaagtctgaatgcagctctataccctccctggcgaggggtcctgggcccgctgctggtggctggcacggctggtgggggggggctcctggtcgtcgccctcgggctagccctggctttgcctgggagtctggatgaggcgctggaggagggcctggtgactgccttggctcactacaaggacacagaggtgcctgggcactgtcaggccaaaaggctggtggatgagctgcaactgagccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggctctggtgctccttggcctgcggtacctgcaaacagcactggaggggcttggaggggtcattgatgcgggaggagagacccagggctatctctttcccagtgggctgaaagatatgctgaaaacagcatggctacagggaggggttgcctgcaggccagcacctgaggaggccccaccaggagaagcacctcccaaggaggatctatctgaggcctagaggcctggagcttggggtgaggaagagggagggatggacaagtctgaaaacctcacaactccttaccaaggctccaggttggggggatcgtaggattagaggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaataaagtttttgga

SEQ ID NO: 285240 - DNA, 1217 bp, Homo sapiens
tggtgtgccagagccctgcagggaggaagggggcacctgcagccgcagcaggcgaagggcttctgccagggctgcctttaccagttccatctcctgctcctgcacccgaagccgctggctcagagactggagggcctcccgagcagggccgtcacctgggaaaagggcaagaggtactcagaatgtacccatcacctgaagaaagcgtagaggggattctgtctccccacaactttacatgtgtccggtaggactgcccctttcaggcagccccaggcttgaatgctcgtccagaggggaggagacggtggtaaaggatcaagggcctccttctggcagggcaggcgagaaacctggcaaagctcccttcctgctgccgtctcagcctccgcaaagactgggagtaccatggagtaccgggggggaaatatggagtactgccgaggaacgtgggagccacagagagaggcgccgcactgccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggctctggtgctccttggcctgcggtacctgcaaacagcactggaggggcttggaggggtcattgatgcgggaggagagacccagggctatctctttcccagtgggctgaaagatatgctgaaaacagcatggctacagggaggggttgcctgcaggccagcacctgaggaggccccaccaggagaagcacctcccaaggaggatctatctgaggcctagaggcctggagcttggggtgaggaagagggagggatggacaagtctgaaaacctcacaactccttaccaaggctccaggttggggggatcgtaggattagaggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaataaagtttttgga

SEQ ID NO: 285241 - DNA, 1544 bp, Homo sapiens
  misc_feature (909)..(909): n is a, c, g, or t
  misc_feature (1034)..(1034): n is a, c, g, or t
  misc_feature (1191)..(1191): n is a, c, g, or t
  misc_feature (1249)..(1249): n is a, c, g, or t
  misc_feature (1253)..(1253): n is a, c, g, or t
  misc_feature (1304)..(1304): n is a, c, g, or t
  misc_feature (1353)..(1353): n is a, c, g, or t
  misc_feature (1385)..(1385): n is a, c, g, or t
  misc_feature (1392)..(1392): n is a, c, g, or t
  misc_feature (1452)..(1452): n is a, c, g, or t
  misc_feature (1454)..(1454): n is a, c, g, or t
  misc_feature (1480)..(1480): n is a, c, g, or t
  misc_feature (1484)..(1484): n is a, c, g, or t
  misc_feature (1492)..(1492): n is a, c, g, or t
  misc_feature (1498)..(1498): n is a, c, g, or t
  misc_feature (1514)..(1514): n is a, c, g, or t
  misc_feature (1543)..(1543): n is a, c, g, or t
tttttttttagtataaatataggttttaatattttctctctacattctatggacaacctccatgcctttgcacatgctgatccctcctcctggaattcctttcctacttgtcctcatgtacaattttctgctcgtccttcaaggggcagcttgcaagcctccctttagacacctctacaggtacagccgaccatgccctacctccatggcactgccaggggacccttataggcctctgtctttaaacctgtaatggtatattaatccttggtgtttgaatgtctctctctcccctgccagctcaagaacctgttgagaggagcacctagcataagacctggcttgtgacaggtttgtaataagtacattgatgatgcagtgagttgaatagtggagtgagtgaagaggaggtggtcaaaatatctaacaacccatatagtggctaggtgggggatggtggtgggaagttcaagggcatggcaccagcatctgcttgaccatctggtgaaggctttcatgacagaaggggagagggcaaagaagtacatgcagaagagaccgcaagggcaagctaagctcacctttatgatgagctgctcttgtgagaactaatgcacttcctagaactaactcaatcctgtgttaatggcattaatccattcgtgagggctctaccctcatgacccaatcaccttttaaggccccacctcccagttccatcagtggcaactaaatttcagcataagtttttatggagacactcaaaacatactatatacatatagtacgcctctgcagtcaaacctcaagccagtcttcttttcccatctcatttacctttccaaataaggcctttaacccaatcccagtctgaccatggtgcatgaactagacatgtgagatttcatnttgcataaatatatatatgtatatatatatatatatatagtatatatactgtgtttcaggtgtccccataaaaattaacatttttatatatcatattatatataacatatataacatttatatancatattatatataacatttatatatcatattatatataacataacatttatatatatcatattatatataacatataacatttatatatcatattatatataacatataacatttatatatcatattatatataacataacatttatatatcatatnatatataacataacatttatatatcatatcatatataacatataacatttatatatcntatnatatataacatataacatttatatatcatattatatataacatataacatntatatatcatattatatataacatataacatttatatatcatattatanataacatataacatttatatatcatattatanataacanataacatttatatatcatattatatataacataacatttatatatcatattatatataananataacatttatatatcatattatatntaanataacatntatatntcatattatatataanataacatttatatatcatattatatatant

SEQ ID NO: 285242 - DNA, 1546 bp, Homo sapiens
  misc_feature (911)..(911): n is a, c, g, or t
  misc_feature (1036)..(1036): n is a, c, g, or t
  misc_feature (1193)..(1193): n is a, c, g, or t
  misc_feature (1251)..(1251): n is a, c, g, or t
  misc_feature (1255)..(1255): n is a, c, g, or t
  misc_feature (1306)..(1306): n is a, c, g, or t
  misc_feature (1355)..(1355): n is a, c, g, or t
  misc_feature (1387)..(1387): n is a, c, g, or t
  misc_feature (1394)..(1394): n is a, c, g, or t
  misc_feature (1454)..(1454): n is a, c, g, or t
  misc_feature (1456)..(1456): n is a, c, g, or t
  misc_feature (1482)..(1482): n is a, c, g, or t
  misc_feature (1486)..(1486): n is a, c, g, or t
  misc_feature (1494)..(1494): n is a, c, g, or t
  misc_feature (1500)..(1500): n is a, c, g, or t
  misc_feature (1516)..(1516): n is a, c, g, or t
  misc_feature (1545)..(1545): n is a, c, g, or t
gtgctgggtgatctagaggatcccagttcgacggagactctctacattctatggacaacctccatgcctttgcacatgctgatccctcctcctggaattcctttcctacttgtcctcatgtacaattttctgctcgtccttcaaggggcagcttgcaagcctccctttagacacctctacaggtacagccgaccatgccctacctccatggcactgccaggggacccttataggcctctgtctttaaacctgtaatggtatattaatccttggtgtttgaatgtctctctctcccctgccagctcaagaacctgttgagaggagcacctagcataagacctggcttgtgacaggtttgtaataagtacattgatgatgcagtgagttgaatagtggagtgagtgaagaggaggtggtcaaaatatctaacaacccatatagtggctaggtgggggatggtggtgggaagttcaagggcatggcaccagcatctgcttgaccatctggtgaaggctttcatgacagaaggggagagggcaaagaagtacatgcagaagagaccgcaagggcaagctaagctcacctttatgatgagctgctcttgtgagaactaatgcacttcctagaactaactcaatcctgtgttaatggcattaatccattcgtgagggctctaccctcatgacccaatcaccttttaaggccccacctcccagttccatcagtggcaactaaatttcagcataagtttttatggagacactcaaaacatactatatacatatagtacgcctctgcagtcaaacctcaagccagtcttcttttcccatctcatttacctttccaaataaggcctttaacccaatcccagtctgaccatggtgcatgaactagacatgtgagatttcatnttgcataaatatatatatgtatatatatatatatatatagtatatatactgtgtttcaggtgtccccataaaaattaacatttttatatatcatattatatataacatatataacatttatatancatattatatataacatttatatatcatattatatataacataacatttatatatatcatattatatataacatataacatttatatatcatattatatataacatataacatttatatatcatattatatataacataacatttatatatcatatnatatataacataacatttatatatcatatcatatataacatataacatttatatatcntatnatatataacatataacatttatatatcatattatatataacatataacatntatatatcatattatatataacatataacatttatatatcatattatanataacatataacatttatatatcatattatanataacanataacatttatatatcatattatatataacataacatttatatatcatattatatataananataacatttatatatcatattatatntaanataacatntatatntcatattatatataanataacatttatatatcatattatatatant

SEQ ID NO: 285243 - DNA, 660 bp, Homo sapiens
aggtgggtgattcttttggactaattcatgtggctgcaattggagctggatgatctaaatggtctcactcctaggtctggctgttgatgttggctgttggctgagccaggggccgccagcaggctagcatgggctcttcactcagcagcagggttccccaagaggacaagcccaacacacatgtgcttttcaagcctgtgattatcaggcttgaaatactgcaacatctgctgcaatcagtaacaaccacataagaaagcaatgacaagttatgattactgctctggagggagtgagcaggatgctgtgagagagggttactattccaagtggcacctgggccagcagcattggcatcacctgggacttgtgagaaatccagcatctcaggctccactgcaggtctcctaaatcagaatctacagtttaacaagatccccagcagatgtgtgtgtaagctcaagaacctgttgagaggagcacctagcataagacctggcttgtgacagagagagagagagaagcagagagagagtttttataaggaattggctcacatgattatggaggctgccaagtcccaagatctgcagtcagcaagctggagacccaggagagctgatggtggagttctagtctgaatgtcagcaggctagagac

SEQ ID NO: 285244 - DNA, 583 bp, Homo sapiens
aggtgggtgattcttttggactaattcatgtggctgcaattggagctggatgatctaaatggtctcactcctaggtctggctgttgatgttggctgttggctgagccaggggccgccagcaggctagcatgggctcttcactcagcagcagggttccccaagaggacaagcccaacacacatgtgcttttcaagcctgtgattatcaggcttgaaatactgcaacatctgctgcaatcagtaacaaccacataagaaagcaatgacaagttatgattactgctctggagggagtgagcaggatgctgtgagagagggttactattccaagtggcacctgggccagcagcattggcatcacctgggacttgtgagaaatccagcatctcaggctccactgcaggtctcctaaatcagaatctacagtttaacaagatccccagcagatgtgtgtgtaagctcaagaacctgttgagaggagcacctagcataagacctggcttgtgacagatctgccaccctctagctgggtgacttttagacaagtgatcgacctctctgagccagagtttctaccttgtaaa

SEQ ID NO: 285245 - DNA, 259 bp, Homo sapiens
gcggccgcagccaatctctccccgcgagggcggaggcgccgaaatcaaagcgagagcgcctcggcctctccagctgtccgcgtcttgctggaggtttgttaaatttatttatcttttcaaaaaccagatccttggctgggtgtggttgcccacacctgtcatcccagcactttgggagactgaggcaggaggatcgcttgaacccacgagttggagaccagcctgggcaacatagagagattctgtccctaaaaaaata

SEQ ID NO: 285246 - DNA, 337 bp, Homo sapiens
gcggccgcagccaatctctccccgcgagggcggaggcgccgaaatcaaagcgagagcgcctcggcctctccagctgtccgcgggtcttgctctgttgcctaggctggagtgcagtggtacaagcacggctcactgcagccttgacctcctgggatcaaggtcttgctggaggtttgttaaatttatttatcttttcaaaaaccagatccttggctgggtgtggttgcccacacctgtcatcccagcactttgggagactgaggcaggaggatcgcttgaacccacgagttggagaccagcctgggcaacatagagagattctgtccctaaaaaaata

SEQ ID NO: 285247 - DNA, 1012 bp, Homo sapiens
cgatctcggctcactgcaagctccgcctcccggattcacgccattctcctgcctcagcctcccgaggagctgggactacagggacccgccaccacgcccggctaatttttttgtatttttagtagagacggggtttcaccgtgttagccaggatggtctcgatctcctgacctcctgatccgcccgcctcggcctcccaaagtgctgggattacaggcgtgagccaccgcgcccggccggtactccgaagccctcagatcggcgacctgggcgctgtaggcaccgagaaaatacaggcaccgagccagaagcagtgccgcaaccaagagacctcggcttggcgaaatggcggcgtctggagcctgcgagtgacgccagctggtggggctgtcaaggagaacattcgttacggcgcaaccaacggtactgtcaccaagaaaccgtcgtctctgagaaaaaaagagacgttcggccgccgagaaactccgtacaagtgctgtgacagaaaaaccgccggctccgcgcagcggcaaaagagccaacgggaacgccgggtgctgcgaccatgaccccggcactggaggacgtgggatggagaatgggacacacggagcgagaagggaaacgtttcgtgcagaccaactagcgccgccgccaccggaaaactgactcgccagtgctgccaatgaagtgcgtgtgagaaaccgatgactggtgggaggagcagcgctgggcgctggacccgcgagtgtgagaatctggcggcgctaggacccttcaggcgcgggcacgaggcgaaacccagcgctgttgccaaagacaaatgcgcgttcttttgggcgccatcagcggtgcagccagtgatcactcccaggctctgagaaactagagatgtcagccacaaaccctccgttcagggaaagtttgcggcgccgtgacggatcgactggcactgggtgcactgctgatagcgcccaaaagaacgcgcatttgtcttgcaacagggccgaca

SEQ ID NO: 285248 - DNA, 1247 bp, Homo sapiens
cgatctcggctcactgcaagctccgcctcccggattcacgccattctcctgcctcagcctcccgaggagctgggactacagggacccgccaccacgcccggctaatttttttgtatttttagtagagacggggtttcaccgtgttagccaggatggtctcgatctcctgacctcctgatccgcccgcctcggcctcccaaagtgctgggattacaggcgtgagccaccgcgcccggccggtactccgaagccctcagatcggcgacctgggcgctgtaggcaccgagaaaatacaggcaccgagccagaagcagtgccgcaaccaagagacctcggcttggcgaaatggcggcgtctggagcctgcgagtgacgccagctggtggggctgtcaaggagaacattcgttacggcgcaaccaacggtactgtcaccaagaaaccgtcgtctctgagaaaaaaagagacgttcggccgccgagaaactccgtacaagtgctgtgacagaaaaaccgccggctccgcgcagcggcaaaagagccaacgggaacgccgggtgctgcgaccatgaccccggcactggaggacgtgggatggagaatgggacacacggagcgagaagggaaacgtttcgtgcagaccaactagcgccgccgccaccggaaaactgactcgccagtgctgccaatgaagtgcgtgtgagaaaccgatgactggtgggaggagcagcgctgggcgctggacccgcgagtgtgagaatctggcggcgctaggacccttcaggcgcgggcacgaggcgaaacccagcgctgttgccaaagacaaatgcgcgttcttttgggcgccatcagcggtgcagccagtgatcactcccaggctctgagaaactagagatgtcagccacaaaccctccgttcagggaaagtttgcggcgccgtgacggatcgactggcactgggtgcaacattgtcttgtggcctagagactagaatataaaaacaaaaaccaaatacaaaactgctgctggcattactcctactctcccccctcaagtcagtggcttcaggcttaagaaaacctgtatttttcttggctgtgccataatccgtaattaccgaggcccccagcgacccacccagtgtgattcgcagagggaaaggagctggaataaggacccagccacggccattggaagagcagtttcctagcaatgtaatgctgtgtgcgacccagcataagctttagctct

SEQ ID NO: 285249 - DNA, 635 bp, Homo sapiens
gttggcgacccggatggcttttgttaccagggccagcccaatccgcccgattctcggtccctatactgcctccttttcccatgcgcatcgcaagggatcggttgatggggccctcagtatgacttcgctaggaaaaataaagtgcagctcgtttctcagagccggcggatgttcatgggcagcaccatcgagccagaagcagtatttgtcctggaggaaatcagtggtgcttcaggatattgtgaatttgggcttctgaaagcagaattctgatttaacagtataatggaattcgtgaacgtcatgatgctaatttgaaccaacaagcacccttgtgagaggaatctgcttttcctcaagtctgaagaacaccaggagaatctttctgtatggagttaccaggaatcctctgctaaggaaagtgaaagggaagatgcaatttctcctgggaaggggggatgctgatgtagagggtgacaagtaatatgccatgaaggattcagtcacctggttagatttagagttagagttatggttaaggaagaaggaaggaaaaaaggcagaagaggaagaaaggaagcaagaaaagataaaatttattctaagataaaatttgtgaattttgctaaactaaa

SEQ ID NO: 285250 - DNA, 321 bp, Homo sapiens
ccagcccaatccgcccgattctcggtccctatactgcctccttttcccatgcgcatcgcaagggatcggttgatggggccctcagtatgacttcgctaggaaaaataaaggtcttcttaggcgggaggggactgatttgaggacggagggtgggagtagtgccagcagcactttgtcgtagtggcactgggtgggcagttatcagttgcagtccgctcgtttctcagtgcccacggtttctcactgacagtgcagctcgtttctcagagccggcggatgttcatgggcagcaccatcgagccagaagcagtatttgtcctg

SEQ ID NO: 285251 - DNA, 2763 bp, Homo sapiens
cgatctcggctcactgcaagctccgcctcccggattcacgccattctcctgcctcagcctcccgaggagctgggactacagggacccgccaccacgcccggctaatttttttgtatttttagtagagacggggtttcaccgtgttagccaggatggtctcgatctcctgacctcctgatccgcccgcctcggcctcccaaagtgctgggattacaggcgtgagccaccgcgcccggccggtactccgaagccctcagatcggcgacctgggcgctgtaggcaccgagaaaatacaggcaccgagccagaagcagtgccgcaaccaagagacctcggcttggcgaaatggcggcgtctggagcctgcgagtgacgccagctggtggggctgtcaaggagaacattcgttacggcgcaaccaacggtactgtcaccaagaaaccgtcgtctctgagaaaaaaagagacgttcggccgccgagaaactccgtacaagtgctgtgacagaaaaaccgccggctccgcgcagcggcaaaagagccaacgggaacgccgggtgctgcgaccatgaccccggcactggaggacgtgggatggagaatgggacacacggagcgagaagggaaacgtttcgtgcagaccaactagcgccgccgccaccggaaaactgactcgccagtgctgccaatgaagtgcgtgtgagaaaccgatgactggtgggaggagcagcgctgggcgctggacccgcgagtgtgagaatctggcggcgctaggacccttcaggcgcgggcacgaggcgaaacccagcgctgttgccaaagacaaatgcgcgttcttttgggcgccatcagcggtgcagccagtgatcactcccaggctctgagaaactagagatgtcagccacaaaccctccgttcagggaaagtttgcggcgccgtgacggatcgactggcactgggtgcaacattgtcttgtggcctagagactagaatataaaaacaaaaaccaaatacaaaactgctgctggcattactcctactctcccccctcaagtcagtggcttcaggcttaagaaaacctgtatttttcttggctgtgccataatccgtaattaccgaggcccccagcgacccacccagtgtgattcgcagagggaaaggagctggaataaggaccgtgaatggggcggatgtggctcgtcctgggagagagctaaagcttatgctggtcgcaaacagcattacattgcaggaaactgctcttccaatggccgtggctgggtccttccacaccatccctctgccctagacctttgtccccgttcagagccatcagagattctaggagagctgtcgacaaccgcatctcttcggaacttggaaactctaggttcaagatctccgtggagaatgaaaggcacagtcgcctgacccgggcatcaggcttgccccgcacatcaagtccctcccctactggatggaactctgtggcaatcgctccttattctgatggttcactctgtcagatatcctcgatatttggggatagtagttcaaaaacagccggggaggaaaatgggctgaaagattccagcgttggatgtagaattgacagcgagacatacacctcctctctaagcccagagaaaagctcaagttgtggttctctgtctctagcagcatgatcttcaaaatgcatcattgatttctatcttctgggaaatgcaatgcaggtgaacttgtaagtgctcaaatcctccatctcctcacttttcagactgaggccttttttttttaaatctgagaagaaatatgggactgccactgctcagtaggaaaatgtcctttcccacaagcatttatattttaataaaaatctgcactttgtgagttgagccccctcaaagagacctacaaaccctgccacaaatatctccaaccacactcatcatttccgattttcatcactgctgctcctgtgcaaaccaaactatcctttccctggggcatcctaggtagaggccatgccaggacaaaggcagagatatgcctgcctggtaaggaaatccattttggccttgtaattctcaccctctcccaagatgtttgcctcaatatctccttcccaccttaccccgtcttcagctagccaaaacattccctggtatttgaggcccttccaatttcctcctggttttgtgggtgggagaataaagaaaaaactgcactgttcccacccacatagttacagccactttatcaaacagaagagcagtctggagccattgcaaaacaaaatacctgccacaactcctctcttctcatttcgactccagcttttcatcttagcaaaaaagttgcaatcagcaccccctagacggaaggaatatcctgtcttaatgggagtccataggaggctgcaggctgctcccctacagagactaacatcaaggtagttgcagaattcagattctaattacagtgtggttggaggcggggtggattccagggaggtcaggaagaggtaaagtacagaattgagctccttgggaggaggtcataggaactttgcagtatgaaaatggctagagattgggtagaattgagcaggctggcaatggcagttttgtgtgggtggtaggacctaggattcaaacttgagggcaaattgtggagcacatacgacaaatgatgtagagcctttcctatttcccttcctggtgtgtcatccgaaacaataaataataaagaattaacaaagactga

SEQ ID NO: 285252 - DNA, 2160 bp, Homo sapiens
cgatctcggctcactgcaagctccgcctcccggattcacgccattctcctgcctcagcctcccgaggagctgggactacagggacccgccaccacgcccggctaatttttttgtatttttagtagagacggggtttcaccgtgttagccaggatggtctcgatctcctgacctcctgatccgcccgcctcggcctcccaaagtgctgggattacaggcgtgagccaccgcgcccggccggtactccgaagccctcagatcggcgacctgggcgctgtaggcaccgagaaaatacaggcaccgagccagaagcagtgccgcaaccaagagacctcggcttggcgaaatggcggcgtctggagcctgcgagtgacgccagctggtggggctgtcaaggagaacattcgttacggcgcaaccaacggtactgtcaccaagaaaccgtcgtctctgagaaaaaaagagacgttcggccgccgagaaactccgtacaagtgctgtgacagaaaaaccgccggctccgcgcagcggcaaaagagccaacgggaacgccgggtgctgcgaccatgaccccggcactggaggacgtgggatggagaatgggacacacggagcgagaagggaaacgtttcgtgcagaccaactagcgccgccgccaccggaaaactgactcgccagtgctgccaatgaagtgcgtgtgagaaaccgatgactggtgggaggagcagcgctgggcgctggacccgcgagtgtgagaatctggcggcgctaggacccttcaggcgcgggcacgaggcgaaacccagcgctgttgccaaagacaaatgcgcgttcttttgggcgccatcagcggtgcagccagtgatcactcccaggctctgagaaactagagatgtcagccacaaaccctccgttcagggaaagtttgcggcgccgtgacggatcgactggcactgggtgcaacattgtcttgtggcctagagactagaatataaaaacaaaaaccaaatacaaaactgctgctggcattactcctactctcccccctcaagtcagtggcttcaggcttaagaaaacctgtatttttcttggctgtgccataatccgtaattaccgaggcccccagcgacccacccagtgtgattcgcagagggaaaggagctggaataaggaccgtgaatggggcggatgtggctcgtcctgggagagagctaaagcttatgctggtcgcaaacagcattacattgcaggaaactgctcttccaatggccgtggctgggtccttccacaccatccctctgccctagacctttgtccccgttcagagccatcagagattctaggagagctgtcgacaaccgcatctcttcggaacttggaaactctaggttcaagatctccgtggagaatgaaaggcacagtcgcctgacccgggcatcaggcttgccccgcacatcaagtccctcccctactggatggaactctgtggcaatcgctccttattctgatggttcactctgtcagatatcctcgatatttggggatagtagttcaaaaacagccggggaggaaaatgggctgaaagattccagcgttggatgtagaattgacagcgagacatacacctcctctctaagcccagagaaaagctcaagttgtggttctctgtctctagcagcatgatcttcaaaatgcatcattgatttctatcttctgggaaatgcaatgcaggtgaacttgaggaaatcagtggtgcttcaggatattgtgaatttgggcttctgaaagcagaattctgatttaacagtataatggaattcgtgaacgtcatgatgctaatttgaaccaacaagcacccttgtgagaggaatctgcttttcctcaagtctgaagaacaccaggagaatctttctgtatggagttaccaggaatcctctgctaaggaaagtgaaagggaagatgcaatttctcctgggaaggggggatgctgatgtagagggtgacaagtaatatgccatgaaggattcagtcacctggttagatttagagttagagttatggttaaggaagaaggaaggaaaaaaggcagaagaggaagaaaggaagcaagaaaagataaaatttattctaagataaaatttgtgaattttgctaaactaaa

SEQ ID NO: 285253 - DNA, 543 bp, Homo sapiens
tgggtgagctctagtcattctgtgagaggaactccaggagaccagatccaactcgcaatcagctatagtgaagttatgatatgagaagcaccaacttggcacaagacttgggaaaggcaatgaggcagcaggcaagctttaagggatgacacttaccttgagggagcaaggacaagttgtgaccttcccagtcctctctccatttgcagatcagcaagcttctgtcagcaaggaggggtggacaatgaaactgggttcagcttgatttgttttttgagacaggtatggcaaggggctgccaacaagatcaagctgcagaggaaacagccacctggggcgtgttcttacgttgcctggaagctgcacaagaggccaagtcaaaacatgcagaattccagttgcccatgatgtcacaggctgaggcccacactccagagacactgtggactgactggcacctatgagctgacctaataacagttacaccattacagctccgattctacagaacaatacatatccagttcttatctaaaaaaaaaa

SEQ ID NO: 285254 - DNA, 856 bp, Homo sapiens
tgggtgagctctagtcattctgtgagaggaactccaggagaccagatccaactcgcaatcagctatagtgaagttatgatatgagaagcaccaacttggcacaagacttgggaaaggcaatgaggcagcaggcaagctttaagggatgacacttaccttgagggagcaaggacaagttgtgaccttcccagtcctctctccatttgcagatcagcaagcttctgtcagcaaggaggggtggacaatgaaactgggttcagcttgatttgttttttgagacaggtatggcaaggggctgccaacaaggtaagtcatctttggacaagccaagtgctttgggaaacaattgtttctgaaaataagtgtttgtgtcaaacattctctttgttagtaggagacatttttgttggatcatgttgtcctcagcaaaagaggttgcagagaagttaaggaagttgggataacttagagtctcagtgctttggggcaatttacagacagcactgtgtgatcctcccatctcaggacttacatcatgttgctaactccctcactgggggccatggttctgaaaggaagaaagcatgtcttattcactcacctttgagtctccagcactgagcacagcacctgtcactcagtaggcactcaataaatgtacattgatatgaaacatgacacgtggtgccttttacagaacaaaaattactttgtcctaaaggcctccagggatgcaattcctgaattttagtatgtgtctaccttagggttgaggtaatggttaagtgtgacacgaaagggttagtttggctgaaatagttcttcctgtggtattaactggtaaaatgaaatataa

SEQ ID NO: 285255 - DNA, 575 bp, Homo sapiens
ttatcccagccccttcctactcccattgaatgcagctctgtgaggacacgatatttgaagctgcagtagctgaggtggcaaaagatggcagaacagaagagcagacagaatctgggtcctagatgacttcattgcactgctgcaactgccttctccagacctcttgccaggtgaagaaattgagacccagagtgattatatgacctgcccaaggtggtcacgtcgttaggccatggcagagatctgaaataaaaggtcaggtcttctgacttcagtccatgcttttttttttttttttttctataacatcatgctacctagaagaaaaagaaatgaagatcaagctgcagaggaaacagccacctggggcgtgttcttacgttgcctggaagctgcacaagaggccaagtcaaaacatgcagaattccagttgcccatgatgtcacaggctgaggcccacactccagagacactgtggactgactggcacctatgagctgacctaataacagttacaccattacagctccgattctacagaacaatacatatccagttcttatctaaaaaaaaaa

SEQ ID NO: 285256 - DNA, 459 bp, Homo sapiens
tgggtgagctctagtcattctgtgagaggaactccaggagaccagatccaactcgcaatcagctatagtgaagttatgatatgagaagcaccaacttggcacaagacttgggaaaggcaatgaggcagcaggcaagctttaagggatgacacttaccttgagggagcaaggacaagttgtgaccttcccagtcctctctccatttgcagatcagcaagcttctgtcagcaaggaggggtggacaatgaaactgggttcagcttgatttgttttttgagacaggtatggcaaggggctgccaacaagaattccagttgcccatgatgtcacaggctgaggcccacactccagagacactgtggactgactggcacctatgagctgacctaataacagttacaccattacagctccgattctacagaacaatacatatccagttcttatctaaaaaaaaaa

SEQ ID NO: 285257 - DNA, 407 bp, Homo sapiens
ttatcccagccccttcctactcccattgaatgcagctctgtgaggacacgatatttgaagctgcagtagctgaggtggcaaaagatggcagaacagaagagcagacagaatctgggtcctagatgacttcattgcactgctgcaactgccttctccagacctcttgccagatcaagctgcagaggaaacagccacctggggcgtgttcttacgttgcctggaagctgcacaagaggccaagtcaaaacatgcagaattccagttgcccatgatgtcacaggctgaggcccacactccagagacactgtggactgactggcacctatgagctgacctaataacagttacaccattacagctccgattctacagaacaatacatatccagttcttatctaaaaaaaaaa

SEQ ID NO: 285258 - DNA, 2132 bp, Homo sapiens
tgataaatttcttctcagaaagccttagcaaaatgggtgcttttattttcacagacatgtctatgcaatacactcagtcacaagagagagcttcttaagcctgaccataatttaaactctgaaaggtgagtgagcctgttaagagacctccacccttctagtaacctatatcccttgatatgggaaggatatcttagttctccctagccccttgcttaggattaagtgagagacttcagctttggtgtaaagctgtcagctgccctaatcaaggacaatacacaaaaattagactccttataagaataagggattaaatggaggaagatctagaagtgggtgggaacaaaagagcagaactgagcctgcatctgcagaaaatgtccaaagacaactggcagagttcactccatggggaaaaggcatgttagtgtgtaggtagagaaactggacaaggaaggatggccttagccttccataatggagaagtcgggcaggggatgtctgcatgcaatagacaactgaattagaaagagcagaaatgtaaaccagcagtgcttccctatcttgggcctggctagcttaaaggggctctactgtcattggtcaaaaaactttcatgaggagatccaatcactaatgcaacaaactctaatgagttctaagttggagagagctcagttctaaagcttgggggtagacaggtcactgagagaggaggaatgaaggagtgggatctgaacattgtaataagtcatctagtagctctgatcactttggacattgctgggggatacataacagctcactataacattacaacacatacttatatctgtttgctcctccaaactaacatgacaatgtgtttctgccatcttagcttacagagacatgatctagttcagcttatactcagattttacaaaagagactttgaccacatagatattcataaaattaatgtggttaagaaaaaagtgcaggggcttgaagtcagaagagctccgttcccattttggctatgctgctgttcaggtttgtgacctgcagagcagtttagcatctctgggtctcaatttgttcatctgtagagcgtgggtgatcaacctttatgtaatccttctgtgttgagtgggtctcaagatggaagctcactatgggaatttaaaagcaaactgtggcatcgaaacaaactggacaattgcttgaactctaatatcatcatccatcctcataaagtaacttgttggtcactagtctgacagtactgttaaaagacatttatttgtaacttttgagaaaataattttcagactctgatcttagaataagctcatgagaagtctcatttccaagctggagatcatttccagtttgaatgaacaattcttctttttggcttgggtgaacgtggggataggtgaaagctgagctgcacatccttcagaggtcacaatgaaaagtcagtctttattctagcagggcttggtcatctggaatagctggtacataggtggcagctccatgccctatctcatactttaaacaacatcaccaatatctttttccgaaataagcttgagttgtatatgtttattataggagagaaaagtttgccaagtgtcttctatggactaagcacttgctaggtgttttacatatattctgccatttaatcctcaaggcaactttaacatgtaagtattactgtcctcattttacaggtgaagaaattgagacccagagtgattatatgacctgcccaaggtggtcacgtcgttaggccatggcagagatctgaaataaaaggtcaggtcttctgacttcagtccatgcttttttttttttttttttctataacatcatgctacctagaagaaaaagaaatgaagatcaagctgcagaggaaacagccacctggggcgtgttcttacgttgcctggaagctgcacaagaggccaagtcaaaacatgcagaattccagttgcccatgatgtcacaggctgaggcccacactccagagacactgtggactgactggcacctatgagctgacctaataacagttacaccattacagctccgattctacagaacaatacatatccagttcttatctaaaaaaaaaa

SEQ ID NO: 285259 - DNA, 2040 bp, Homo sapiens
  misc_feature (3)..(3): n is a, c, g, or t
  misc_feature (5)..(5): n is a, c, g, or t
  misc_feature (7)..(8): n is a, c, g, or t
ggnangnngatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaa

SEQ ID NO: 285260 - DNA, 555 bp, Homo sapiens
tagttgaaatggggtttgggaagtgatgagggctttgaaaacacatgaagcaggtattggacatcagcagatagatgagactccttggcaccacagtccgagcctggggttgggggatagctggggagttgtcaggcaggaacattgatgtagtcatctgaatcactgtcctccatcatggcggcaggctggtggtagaggctcacgtattcacagctggtcttcagagatggggcatggagccaggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaa

SEQ ID NO: 285261 - DNA, 1945 bp, Homo sapiens
  misc_feature (3)..(3): n is a, c, g, or t
  misc_feature (5)..(5): n is a, c, g, or t
  misc_feature (7)..(8): n is a, c, g, or t
ggnangnngatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaaga

SEQ ID NO: 285262 - DNA, 1937 bp, Homo sapiens
  misc_feature (3)..(3): n is a, c, g, or t
  misc_feature (5)..(5): n is a, c, g, or t
  misc_feature (7)..(8): n is a, c, g, or t
ggnangnngatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggagaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaa

SEQ ID NO: 285263 - DNA, 1123 bp, Homo sapiens
gcagcctttcgtttggggagggtggcacgggcctctgatgccattttcctccctcttcccgtggctttgtggggaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaa

SEQ ID NO: 285264 - DNA, 590 bp, Homo sapiens
tagttgaaatggggtttgggaagtgatgagggctttgaaaacacatgaagcaggtattggacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaa

SEQ ID NO: 285265 - DNA, 897 bp, Homo sapiens
  misc_feature (3)..(3): n is a, c, g, or t
  misc_feature (5)..(5): n is a, c, g, or t
  misc_feature (7)..(8): n is a, c, g, or t
ggnangnngatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtggtaggttcctccgctgattggaggctcagactacccagaaaatgtttcacttgggaagattggaacagccatctaactgtaacagtctcctagactcttacactgttgccatataagccacataatgattgagatccatatgaaacctcatagtcaattacctccatggtccacacaattttctacccaacatgtatgaaaagaacaagataggtgctctctttgtattgttcatcctacccagggcatgaggggagtagaggcttgagattgaggagaggctctgagatggaggaaattggaagcaaaaggaaataactatccaacgtaattgtcccatgagaaataaaggaaagacactaatttatcca

SEQ ID NO: 285266 - DNA, 484 bp, Homo sapiens
tcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagaggtaagagaccactgtccaggatctagagttaggctagaattaagagatccactgaaacccactgcaatgtccattattagacaccctccttggctttgtctctaggccactgtgaaatataccacctatgagtatagctcattaactcattagttcctttaacaaaaacacacttgtcaatgccccagcattgatcctgtagaaagaagtgagacccagctcttccagtcacttagattcattcagatctatttttatggggaagaactaaatgagaataaaaataaaattaactattaaactagtaa

SEQ ID NO: 285267 - DNA, 405 bp, Homo sapiens
ttcaacataacatcagtgacaggaacttgctgaggtgaaaggtgactccatgttcttttctcatttgtccacagtgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 285268 - DNA, 3600 bp, Homo sapiens
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccctgcacaagatgccccagggatgggaggtatgggctgggggctatgtatagtctgtatacgttttgaggagaaatttgataatgacactgtttcctgataataaaggaactgcatcag

SEQ ID NO: 285269 - DNA, 3194 bp, Homo sapiens
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccctgcacaagatgccccagggatgggaggtatgggctgggggctatgtatagtctgtatacgttttgaggagaaatttgataatgacactgtttcctgataataaaggaactgcatcagaaaaaataccatgccactttatgtattattatgttggggaggaatgataacagggaacaagaagagaagcaggggttaatccactcactttcctctttagagaagctccctcacccatcccaacacctcaagtcacactcatgaagatagagacagtcatttgggagatttaaagggatatcctcaaaacagaacaccagcctctcaccaccagagatgaccggaaatatgttttctcttcttccttccctgcatcaggggaagaggctggtgaagttggtgagcatcagctggaccagctgccctgggtagagagcatgggctgctgggt

SEQ ID NO: 285270 - DNA, 3931 bp, Homo sapiens
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccctgcacaagatgccccagggatgggaggtatgggctgggggctatgtatagtctgtatacgttttgaggagaaatttgataatgacactgtttcctgataataaaggaactgcatcagaaaaaataccatgccactttatgtattattatgttggggaggaatgataacagggaacaagaagagaagcaggggttaatccactcactttcctctttagagaagctccctcacccatcccaacacctcaagtcacactcatgaagatagagacagtcatttgggagatttaaagggatatcctcaaaacagaacaccagcctctcaccaccagagatgaccggaaatatgttttctcttcttccttccctgcatcaggggaagaggctggtgaagttggtgagcatcagctggaccagctgccctgggtagagagcatgggctgctgggt

SEQ ID NO: 285271 - DNA, 542 bp, Homo sapiens
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgaggtgcagtcagccccgggccaagaggcccctaaagcccctacccaagtccattaaaagtctcaagccctcaaacta

SEQ ID NO: 285272 - DNA, 591 bp, Homo sapiens
gctctcttcctgcttttgctatcttgctggcgcatctgctcacgcacgctgctgatgcaagcggccttgcgccctggggctgggcctgagaagggaggagttgctcaaccccttaagctttcaggccctggagagaatcttacaatatcagaagtgggattcacatagcgcttcccgtgaccctccaggaatatcaagtgacccagcaagacctgacacctaatgaatgtgtgaatagaaaacacctagatgctcagaagaatgggtagtgaaatattcgtattcatataccaatcagagagttttggctgatcacaggctgccaactgttcaaaccacattcaaataagggctgtgaccgtctacgacaagctggcatctttctttaaagaggcacctctggacctgcagcaccggctcctcatgaagctcagaacctgaggacccagccatggagcggtcagccttcatggagcaggatgctgggagcgggctggtgatgcgtctccatgagcggccagccctgctggtcagcagcacacctggacagtcctggatgcccccaccccgccacggtctcaatgagaaggg

SEQ ID NO: 285273 - DNA, 703 bp, Homo sapiens
agaattctctcccctaccaggtgtccctgaattctggctcccacttctgcggtgggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctcac

SEQ ID NO: 285274 - DNA, 660 bp, Homo sapiens
aggcacaatggttcacgtctgtgattccagcactttgggaggctgaggtggaaggatgacttgtctactaaaaataaaataattagccaagcgtggtggtgcacacctgtagtcccagctactcaggaagctgaggcaggaggatcacttgaaccctggggacggaggttgcagtgagttgagatcgtgccactgtactccagcctgggtgacagagtgagaccttgtctcaaaaaaaagaagaaaaaaagaccgcccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctcac

SEQ ID NO: 285275 - DNA, 541 bp, Homo sapiens
gcctggcactgctgaccaccggagccttcgcgctcttcggggtcttcgccttggcctccatctctagcgtgccgctctgcccgctccgcctaggctcctccgcgctcaccactcagtacggcgccgccttctgggtcacgctggcaaccggcgtcctgtgcctcttcctcggaggggccgtggtgagtctccagtatgttcggcccagcgctcttcgcacccttctggaccaaagcgccaaggactgcagccaggagagagggggctcacctcttatcctcggcgacccactgcacaagcaggccgctctcccagacttaaaatgtatcaccactaacctgtgagggggacccaatctggactccttccccgccttgggacatcgcaggccgggaagcagtgcccgccaggcctgggccaggagagctccaggaagggcactgagcgctgctggcgcgaggcctcggacatccgcaggcaccagggaaagtctcctggggcgatctgtaaataaacctttttttcttttgttttttaaaaa

SEQ ID NO: 285276 - DNA, 734 bp, Homo sapiens
tccagtttacagaatgaattcacatctattaccctatttgcccctctcaatagttcgcagaaacaggcactgttatgaccattttacagatgaaaagtggggggctcagaagggtttggtgtcttgccgtgtttcatgtaattcagattagaggtgtgtggcgggaggtaacacaaggggtaggctccaaaagatggaagaaggcccgggcatcacgcctgtaatcccagcactttgggaggtcgaggcaggaaggtcgtttgaggccagagttcgagaccagcctgggcaacatagccctgactccacatgccctcctttctttcgatccccaccgccacaggcgtcctgtgcctcttcctcggaggggccgtggtgagtctccagtatgttcggcccagcgctcttcgcacccttctggaccaaagcgccaaggactgcagccaggagagagggggctcacctcttatcctcggcgacccactgcacaagcaggccgctctcccagacttaaaatgtatcaccactaacctgtgagggggacccaatctggactccttccccgccttgggacatcgcaggccgggaagcagtgcccgccaggcctgggccaggagagctccaggaagggcactgagcgctgctggcgcgaggcctcggacatccgcaggcaccagggaaagtctcctggggcgatctgtaaataaacctttttttcttttgttttttaaaaa

SEQ ID NO: 285277 - DNA, 1406 bp, Homo sapiens
agaggctgtgttgaggctaatggcggtgcccacggaactggatggagggagtgttaaggagaccgcagcggaagaggaatcgcgagttctggcacctggcgccgccccgttcggaaattttcctcattattctcgcttccaccctccggagcaacggctccgcctcctgcccccggagctgcttcgacagctctttcctgagagtcccgagaacgggccgattctggggctcgacgtggggtgtaactccggggatctgagtgtggctctatacaaacacttcctctccctacctgacggggaaacctgctcagatgcctcaagagaattccgtctcctctgctgcgacatagatccagtcctggtgaagcgagccgaaaaagaatgtccttttcctgatgccttgacttttatcaccctggacttcatgaatcaaaggacccggaaggttctcttgagctctttcttaagccaatttggacgttcagtttttgacattggcttctgcatgtcaataaccatgtggattcatctgaatcatggagaccatggcctatgggagttcctggcccatctttcctccctctgccactacctccttgtggagccccaaccctggaagtgttaccgggcagctgcaaggcgtctccgaaagctgggactccatgattttgaccacttccactcccttgccatccgaggtgacatgcccaatcagattgtgcagatcttgacccaggatcatggcatggaattaatatgttgctttggcaacaccagttgggacagaagccttctgctcttcagggcaaaacaaaccatagagactcatccaatccctgaatcactgatagaaaaagggaaagaaaagaacagattaagtttccagaagcagtgagatgggagggcaagaagaccaagaaagatattgaaagggttttatattgagaattatgttcattctccttaattccttaacaatcaggcagccgcaaaacctggcaggagcttttggtaaaatgtccaaggcacataattgaaagaatcagtatctgttccccattgtttggaacaaatcttgaggagaatgaatctgtggagtgatgagctaggatatctggattgagatggcctaggaaaagtggtcctggttatgggttatggagagggctgcttttggggattatttataaagatcagactaggctagtcttaaaatatgtcagttcctgggctctctgaatcctacctggtttcttcaggcttctggacttgctaggcctgcctttgggcaaaaccttagtaattcaggtctggaatggggcttaggaatctattttctgtttttttgtttgtttgtttttgcattcttctattgtaatatatacataaaatttaccatttta

SEQ ID NO: 285278 - DNA, 1498 bp, Homo sapiens
agaggctgtgttgaggctaatggcggtgcccacggaactggatggagggagtgttaaggagaccgcagcggaagaggaatcgcgagttctggcacctggcgccgccccgttcggaaattttcctcattattctcgcttccaccctccggagcaacggctccgcctcctgcccccggagctgcttcgacagctctttcctgagagtcccgagaacgggccgattctggggctcgacgtggggtgtaactccggggatctgagtgtggctctatacaaacacttcctctccctacctgacggggaaacctgctcagatgcctcaagagaattccgtctcctctgctgcgacatagatccagtcctggtgaagcgagccgaaaaagaatgtccttttcctgatgccttgacttttatcaccctggacttcatgaatcaaaggacccggaaggttctcttgagctctttcttaagccaatttggacgttcagtttttgacattggcttctgcatgtcaataaccatgtggattcatctgaatcatggagaccatggcctatgggagttcctggcccatctttcctccctctgccactacctccttgtggagccccaaccctggaagtgttaccgggcagctgcaaggcgtctccgaaagctgggactccatgattttgaccacttccactcccttgccatccgaggtgacatgcccaatcagattgtgcagatcttgacccaggatcatggcatggaattaatatgttgctttggcaacaccagttgggacagaagccttctgctcttcagggcaaaacaaaccatagagactcatccaatccctgaatcactgatagaaaaagggaaagaaaagaacagattaagtttccagaagcagtgagatgggagggcaagaagaccaagaaagatattgaaagggttttatattgagaattatgttcattctccttaattccttaacaatcaggcagccgcaaaacctggcaggagcttttggtaaaatgtccaaggcacataattgaaagaatcagtatctgttccccattgtttggaacaaatcttgaggagaatgaatctgtggagtgatgagctaggatatctggattgagatggcctaggaaaagtggtcctggttatgggttatggagagggctgcttttggggattatttataaagatcagactaggctagtcttaaaatatgtcagttcctgggctctctgaatcctacctggtttcttcaggcttctggacttgctaggcctgcctttgggcaaaaccttagtaattcaggtctggaatggggcttaggaatctattttctgtttttttgtttgtttgtttttgcattcttctattgtaatatatacataaaatttaccattttaaccgtttttaagtacagtttttcagaacgtggaaatcccatcaaaaattggattaaaaaattaaaagataaattgataatttttttaaaagt

SEQ ID NO: 285279 - DNA, 1287 bp, Homo sapiens
  misc_feature (3)..(3): n is a, c, g, or t
  misc_feature (85)..(85): n is a, c, g, or t
  misc_feature (89)..(89): n is a, c, g, or t
  misc_feature (98)..(98): n is a, c, g, or t
  misc_feature (101)..(102): n is a, c, g, or t
  misc_feature (117)..(117): n is a, c, g, or t
  misc_feature (120)..(120): n is a, c, g, or t
  misc_feature (132)..(132): n is a, c, g, or t
ccnccccccccccggctctcacgtttcctaagcccagacgccattgggcccacgggggaacccgggtctatgggccaaaaaaaantctnccctcctanggnntcttttttttttttnganattcttctcttngcgcaacatgatccagtcctggtgaagcgagccgaaaaagaatgtccttttcctgatgccttgacttttatcaccctggacttcatgaatcaaaggacccggaaggttctcttgagctctttcttaagccaatttggacgttcagtttttgacattggcttctgcatgtcaataaccatgtggattcatctgaatcatggagaccatggcctatgggagttcctggcccatctttcctccctctgccactacctccttgtggagccccaaccctggaagtgttaccgggcagctgcaaggcgtctccgaaagctgggactccatgattttgaccacttccactcccttgccatccgaggtgacatgcccaatcagattgtgcagatcttgacccaggatcatggcatggaattaatatgttgctttggcaacaccagttgggacagaagccttctgctcttcagggcaaaacaaaccatagagactcatccaatccctgaatcactgatagaaaaagggaaagaaaagaacagattaagtttccagaagcagtgagatgggagggcaagaagaccaagaaagatattgaaagggttttatattgagaattatgttcattctccttaattccttaacaatcaggcagccgcaaaacctggcaggagcttttggtaaaatgtccaaggcacataattgaaagaatcagtatctgttccccattgtttggaacaaatcttgaggagaatgaatctgtggagtgatgagctaggatatctggattgagatggcctaggaaaagtggtcctggttatgggttatggagagggctgcttttggggattatttataaagatcagactaggctagtcttaaaatatgtcagttcctgggctctctgaatcctacctggtttcttcaggcttctggacttgctaggcctgcctttgggcaaaaccttagtaattcaggtctggaatggggcttaggaatctattttctgtttttttgtttgtttgtttttgcattcttctattgtaatatatacataaaatttaccattttaaccgtttttaagtacagtttttcagaacgtggaaatcccatcaaaaattggattaaaaaattaaaagataaattgataatttttttaaaagt

SEQ ID NO: 285280 - DNA, 733 bp, Homo sapiens
ggcctgtcctggggacctggcgaggcccggcctctgccagccaagcctgctggggacgaccgaggtagcccgggctcggcttaggaaggcagcgggactcgaggccttggggtccgagtccgaactcgctcctctagcgccgggcggggagcgagtgggagagcggccgcgaagctccagtgttgaaaacgcacccctcccagctttttgcaaggcctacttgggggcggagagacaagcaagctgtcatgttataagcagccctttgaggggtccatgtgatgtcaaggaatgaagtctctagccaacatttaatgaggaactgaggcccaccaacaaccttgagtgagcttggaagtagctccttcagcatcagttgggtgtcgagatgactactgacagcttgactgcaacttcatgagagtcttctggaccagaaccactcagttaagtggctcccagattcctgatcctcagaaactctgagaaataatgaatgttggttgttttaaaatggtaaattttgaggtattatgttatgtggcaatagatagctaatatataaattatttgaatcaaacaatatgttaaattaaagctcagaagaataaacatctgtaattccttaatttgttttcccttctattctacagaatagaattttacagatgaaccttgtagttacttgtgcaataagagacagtatgttgtattgattaagtgcagagcctct

SEQ ID NO: 285281 - DNA, 1276 bp, Homo sapiens
tgcgcgtgcgcgcggggcacccgccgccgaccaggcaagccaggcagcaggcgacccaagaccgtccgcggaggagacaagcaagctgtcatgttataagcagccctttgaggggtccatgtgatgtcaaggaatgaagtctctagccaacatttaatgaggaactgaggcccaccaacaaccttgagtgagcttggaagtagctccttcagcatcagttgggtgtcgagatgactactgacagcttgactgcaacttcatgagagtcttctggaccagaaccactcaagtcagggtttccccatgttggtcagcctggtctcaaactcctgacttcaggtgatccacctgcctcagcctcccaaagcgctgggattacagtttcagttatctacggccaactgggtaaaccaaatagtgcagagatgatatttaaatcatgagactggattttttaaaaaggaagaggactgaagactaagttctgggcactccaattttgggcagtagcggagatgaagaaaaaccagcacactagatggtaaaggagcagccaacaagatgctctttacaaatattttttaacttcttaaaatatctcattgaggattccgttccaagatggccaaataggaacagctctggtctgcagctcccagtgtgatcgacgcagaagacggatgatttctgcatttccaactgaggtaccagttgaatgaagagaagcacacctcctccccagaacagtactgcagctatgatataacgcctgggcagcgttcgcaatagcagccaggctgtaatgtaagctggaatttcaatcaaggcagagaggaaacagttcagatggagtcttgctctgctgcccaggctggagtacagtagtgcgatcaaggctcactggaacctccacctcctgggttcaagtgattctcctgcctcagcctcccaagtagctgggattacagatggagtctagctctgtggcccaggctggagtgcagtggtgtgatctcagctcactgcaacctccacctcccaggttcaagcgattctcctgcctctcagcctcctgagtagctgggattacaggcgagcaccaccgcatctggctaatttttgcattttttgtagagactgggtttcaccatgttggccaggttggtctcaaactcctggcctcaagcagtctgcccactttggcctcccaaagtgctgggattacccagccttgctttttacacttctcttgttgtagtcatttagcatcagaaca

SEQ ID NO: 285282 - DNA, 1133 bp, Homo sapiens
tgcgcgtgcgcgcggggcacccgccgccgaccaggcaagccaggcagcaggcgacccaagaccgtccgcggaggagacaagcaagctgtcatgttataagcagccctttgaggggtccatgtgatgtcaaggaatgaagtctctagccaacatttaatgaggaactgaggcccaccaacaaccttgagtgagcttggaagtagctccttcagcatcagttgggtgtcgagatgactactgacagcttgactgcaacttcatgagagtcttctggaccagaaccactcaagtcagggtttccccatgttggtcagcctggtctcaaactcctgacttcaggtgatccacctgcctcagcctcccaaagcgctgggattacagtttcagttatctacggccaactgggtaaaccaaatagatgctctttacaaatattttttaacttcttaaaatatctcattgaggattccgttccaagatggccaaataggaacagctctggtctgcagctcccagtgtgatcgacgcagaagacggatgatttctgcatttccaactgaggtaccagttgaatgaagagaagcacacctcctccccagaacagtactgcagctatgatataacgcctgggcagcgttcgcaatagcagccaggctgtaatgtaagctggaatttcaatcaaggcagagaggaaacagttcagatggagtcttgctctgctgcccaggctggagtacagtagtgcgatcaaggctcactggaacctccacctcctgggttcaagtgattctcctgcctcagcctcccaagtagctgggattacagatggagtctagctctgtggcccaggctggagtgcagtggtgtgatctcagctcactgcaacctccacctcccaggttcaagcgattctcctgcctctcagcctcctgagtagctgggattacaggcgagcaccaccgcatctggctaatttttgcattttttgtagagactgggtttcaccatgttggccaggttggtctcaaactcctggcctcaagcagtctgcccactttggcctcccaaagtgctgggattacccagccttgctttttacacttctcttgttgtagtcatttagcatcagaaca

SEQ ID NO: 285283 - DNA, 1101 bp, Homo sapiens
ggaagggcaaattctctcattctctctcttcttgagctgggacatccattttctcctgccttcaggaaatcagagctccatgttcttggatctcccgactctgggacttacaccttacccttttcccctcagtctttcagacttggactgaattacaccatcacctttcctggttctccagcttgcagatagcatgtcatgggacttcttagcctctgtaatcatatgagccagttcatatagtaaatctcctcctattgatctatacctatatctgtaatcctattagttgggtttctttggaaaactctaatacccccttatccacagtttttttttttttctgcagtttcagttatctacggccaactgggtaaaccaaatagatgctctttacaaatattttttaacttcttaaaatatctcattgaggattccgttccaagatggccaaataggaacagctctggtctgcagctcccagtgtgatcgacgcagaagacggatgatttctgcatttccaactgaggtaccagttgaatgaagagaagcacacctcctccccagaacagtactgcagctatgatataacgcctgggcagcgttcgcaatagcagccaggctgtaatgtaagctggaatttcaatcaaggcagagaggaaacagttcagatggagtcttgctctgctgcccaggctggagtacagtagtgcgatcaaggctcactggaacctccacctcctgggttcaagtgattctcctgcctcagcctcccaagtagctgggattacagatggagtctagctctgtggcccaggctggagtgcagtggtgtgatctcagctcactgcaacctccacctcccaggttcaagcgattctcctgcctctcagcctcctgagtagctgggattacaggcgagcaccaccgcatctggctaatttttgcattttttgtagagactgggtttcaccatgttggccaggttggtctcaaactcctggcctcaagcagtctgcccactttggcctcccaaagtgctgggattacccagccttgctttttacacttctcttgttgtagtcatttagcatcagaaca

SEQ ID NO: 285284 - DNA, 641 bp, Homo sapiens
gggggcggggcctcgggttaacactgcagccgctagaccagctccctggcgggcgcggagcaagctttgacctttggaactgggcaccgcagccccaatatctgccctgcggtcagagcaacctgaacacttcctagtgaattgcaatgtaaaggtgaccagcgccgccacttgggtgatcttaacttctctcagcctcagttgcctcatctgtaaaatgtgtttcattcaagaaatgattacccagtgtctacttcgtgctaaacagccttgagcccttggcctacagcaatgaataaaaccatttgtgatgctcaaagagaagatggtcggtgtaacgcgcttgtgatgctcaaagagaagatggtcggtgtcatgcgcttctgatgctcaaagagatcggtgtcacgcgcatccgtgtgaagacaccgccaaacaggggacagaatctctctatgttgcccaggctggtctccaactcgtgggttcaagcgatcctcctgcctcagtctcccaaagtgctgggatgacaggtgtgggcaaccacacccagccaaggatctggtttttgaaaagataaataaatttaacaaacctccagcaagactgcaaagaaaaaagaaaaagagaagacacaaatt

SEQ ID NO: 285285 - DNA, 708 bp, Homo sapiens
cgcggcccgcgaatacgcgtggaccttgtggaacgccgggcctccccgggcgcccccgctctctggtagttgccgggagacccggccggtggggaagcccgcggagccgcagccccggccccggaaggtctctctgggccccgggcccgactcccacccctgcgccggcccgcgggcttcgcaggccctgcactgccgaccgggctgcgctcaaggccgccagccgcccgccgccctctttgtccccccgctgcaggaaggccgcggcagagggggcgccctccaagccgtcagccacgcacgcggaggcgctcgggcctcggggcggcgcaccgggagagcacgccggggaggacacgtgggccttcgcgcggattttaaggaaacagagcaacagctacaacaaaatggggagaagaaatgagaactgtgctaacagcctacgtgtgtcaaacatctctcaggagaacttatctcactggaatttggattcagaagtacctgtttctgaaaataaaaacctcccagctggaagggatggagcagcaggtggcaaaattaacaagaactatttggaaattccagtggagcaactgatgctagaacctaatttgtcggtgcatagtcaaaaaagtacacagaatagtaaacaagggatctttcaattatggacattgtcctcttaatgaaggaagtaccatagagaag

SEQ ID NO: 285286 - DNA, 550 bp, Homo sapiens
ataaaatgtgcttttctttctttctaggtgctttcaactgttttaaaactctacaagtaagtattcatttttgtctgtccagtaaatgaagacactgaacaagtcttaacagttatcttggatgaaagagtctagatggtattttggagagttattactggcttaggccttctgacttacattagactttcatctcccttaaaagtcccacagaactgaccatcatctccttaaaactatcgttttgattgttttctattatacctacctccttagattttctgtctccaactctaggggcatttctagctgaagatatttgattgctcctctccttcacatttctctatcttgtaattatattcgaattcatggatttaggccaggtgtggtggctcacacctgtaatcccagcgctttggaaggttgaggatggaggatggcttgaccccaggaggctgaggctgcagtttgttatgattgtgccactgcactccagcctgagcaacagagagagaccctgtctcttaaaacacacacacacacacac

SEQ ID NO: 285287 - DNA, 440 bp, Homo sapiens
agaatggcctgctccagatgggaagtttatctgcctggatcctgaaacgaagacgacatatggatcaggaactgagtcactgacagactacagctgacttacaacttaagtgctttcaactgttttaaaactctacaaggtgtggggctgcagatcggaccggatactggggctcagcgtggatgggtctttcatccattcgtcggattcccacaggcttgatggcatcaggctccacagtgtcaggctgctgcagctggctcaagtcatagtcctgcaaaaagacaaaatcaaaaaccgatgggagatgggcacaaagatagaaaattacaacctcgctttttaagcacatactcagaacacatagaaatgaggaaaatttaacataatggaaaagttgccactatgagtttttcatgttatgattaaatatttctttc

SEQ ID NO: 285288 - DNA, 710 bp, Homo sapiens
tgaggtttggtgactgcggggcaggccgggggcagctgtctgtctggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgcgcttctgaagggcgacgtcgctgcaaagcaccatcctgggcgtcatccccaacacgcctgaccccgccagcgacgcgcaggacctgccgcctgcttgcacaaggattggcacagctgcactggccgttcaggttgtgggcagtaactggcccaaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccaggtacagtgttcccttttgaa

SEQ ID NO: 285289 - DNA, 1316 bp, Homo sapiens
aggcccgggtataaatggtaaaatgttaatatttgagattcttggctttttcttacattattctgtctttccttcttaatttttaattgttactaagagaaagctggtcacagtacactataatctcagctactctggaggctgagccaggagaatcactggagcccaagagtttgattacagcctgggcaacattgcaagatcccatatctaaaaaaaaagcaagcaagcaagagaagcagcggggattttaggaggtgcttctgcagaaaccagtcgtttatatcatcttcaacaatcctggctcttgctgaagtagactaggggcttccccgaggggcggctccacctcatgctgagacctctgcatgccttgggggtggaaatatttgatgagactcccaggggtccttgggaccttgggctgtgaggaccagaaggattagaggactgtgccccttctccccactgtagatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcatgcgccagtgcgtggaggagatcgagcgccgaggcatggaggagataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgggtggcagagaaggaggcggtcaataagatgtccctgcacaacctcgccactgtctttggccccacgctgctccggccctccgagaaggagagcaagctccctgccaaccccagccagcctgtcaccatgactgacagcaggtccttggaggtcatgtctcagggtcccagggctggtggttgctttgggtctacagctacgtcttacccgcctcctgcctcaacagcctgtgtggtggcaaagccggtgtggggctggggaacgcagcgttctccaggaggggacccggctctccttctgcagtgcaggcgaaggcctagatgccagtgtgacctcccacaaggcgtggcttccagactccccggccggaagtgatgcttttttgccgcgggccctgggtttgaagcagcctggctttctcttggtaagtggctggtgtcttagcagctgcaatctgagctcagccacctacacaccaccgtggccgacactttcattaaaaagtttcctgagaaaaaaaaag

SEQ ID NO: 285290 - DNA, 810 bp, Homo sapiens
cctgtgtggaggtattggaattgtccattgctaagactcagaggagaaaagcacttagcatcgcaggacttggagcaccggtgctgaggcaacccttcattcattcgtcggatgtgtgttaaggcccagggcaggggtcagggattctcctctcacacagcacgtgggtggcaggaccaacaccgggtctgacctcccagccgggggcacaggctgctaaccccaggcctggaatctgtcagatgcccttcctgtgctgacttgacttagacaggcctcctgaccttcccgcaaaggtcatgtgtgattcgcaggggttctggccgcttgaaaggttcctgagaaagcacatgccatgaggacagagcttgcagagggaggacaggcatgcagaaggctctgtgtgcagccccagacctgggtaccttcgtcaccgtcctcaccccacctccgggtgtgcagatagggagcaggcctcctgtgttatggcccaagcggggctgttaggacactgagaacattccctcctcccgcaggagagagaggtccaaggtgccctacatcatgcgccagtgcgtggaggagatcgagcgccgaggcatggaggaggtgggcatctaccgcgtgtccggtgtggccacggacatccaggcactgaaggcaggcttcaacgtcagtgagtgtcggcctgcgcaggacgggatggaggtgtgggcagtggtgtccgcgatgagatctcagagtgctccatggcccaggcatgtcacatccttctctgtgtcttttcttcatttactgttttattatttt

SEQ ID NO: 285291 - DNA, 2713 bp, Homo sapiens
  misc_feature (1)..(1): n is a, c, g, or t
  misc_feature (3)..(4): n is a, c, g, or t
ncnnagggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaaatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcaggctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaaaaagtgccc

SEQ ID NO: 285292 - DNA, 2809 bp, Homo sapiens
  misc_feature (1)..(1): n is a, c, g, or t
  misc_feature (3)..(4): n is a, c, g, or t
ncnnagggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggagtgcagtggcgcaatctcggctcactacacctctgcctcccaggctcaagcacttctcctgcctcagactccggataactgggattacaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaaatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcaggctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaaaaagtgccc

SEQ ID NO: 285293 - DNA, 1877 bp, Homo sapiens
  misc_feature (12)..(12): n is a, c, g, or t
  misc_feature (16)..(16): n is a, c, g, or t
tcaggctggtancctncgagtaacgggctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcaggctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaaaaagtgccc

SEQ ID NO: 285294 - DNA, 1069 bp, Homo sapiens
gctggtaccggtccggagttttaggatgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcaggctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaaaaagtgccc

SEQ ID NO: 285295 - DNA, 988 bp, Homo sapiens
ccggccccttccctctcggatgggggccctgggggtgacgtacacaccccatccttcccgcaccgcctctgcccgccgcccgtcgcccgccatagttgttgacgtagctttagtcgatcgcgaagatggctttatggaccctaggttctcctgccggtggtggcgatggcttctcgggggtgttgggcggtggccgctgtggtcagggaggcagttgcgagtcgctggggccgccgcctgcgtcgtcgctgctgtgtagcaaacctgcctctgggcccatggtgtgtcttgagggctgtgagagaggcagtgcctgagctgggtcagctgctgtggatcgctcccgcctcctggctggaggcaccaaagaggaggagaagggggaggaggacgtctctgccatcgcccttaagtaaaggaggggtgggggcgatagaaggatggcagggcaacttgcctgtcctaagtctagccgctcgtggcaagtgttgactgcgtgtaggagactcccgtcctatctcccagtaccaagtctcggggaaaaggagtgcgacgagggtggagaagaccaagtttcgcttctcggccccaggctgttgcgcagtttccctggaatctttttgatcgactgctacgttgaccatgtccttcccagtgtccttagcaggagtgatggccagagagagaacttttgcacatgccatgttttcgtggcaaaaattttagtttcaagtaccttatgagggcggttacctagttttgaattttgtcacttgttgagggtgtacaaaatcctatctagagtcatactcgttggatgtattttcttttccgaaatgtacccataggacacataaccttattcctggtctttaatatttctcggttttataccaagcagcagtgttcggaagaccatgttagtgctacattgtgcacagtgagaaatgaacaagttttttaattaaagacagcactgtaattttaa

SEQ ID NO: 285296 - DNA, 693 bp, Homo sapiens
catgtcaatatctaagactttaattttttccccaacattctctgaggcctttgtgtagatagtagattgtcctcccacccctaaacacattgcagatttttaattggaatggataggtcagatgtaggagacccaggtaaggaggcgtcgaggtcaaaagacctccgagattcctagagcggtcggcgaggggcctgcaagtcgccccggccgcacttccgggacggcccatcttccttgggtactgaagctcgcgagaggatcctgggggcaggcgcgtcgcggtggcagtgtttcttgggtgtgcggggccgggcgccccgtagcctctggtctgcatggggattacaggtgtttggcaagtggcatggcagaacagagaatctagattcaggacctggacttggatataagctgtcacttgttacttggccttgcactaaatgaccattctcaggacaagttcagcaaccctaaaggcaaactggcctagggcctgggaagtggagaatgcctattcctaggctaacccaagcattagagaagcatcaggccgccattctagactcaactgctcacctcctctgatccactgaggtgtctctggaaatcctccaccacagccacagcctcctcaccactctcagggtgatgcagctgcacccaggtccggagctccccagggaggatgct

SEQ ID NO: 285297 - DNA, 566 bp, Homo sapiens
  misc_feature (521)..(521): n is a, c, g, or t
  misc_feature (544)..(544): n is a, c, g, or t
  misc_feature (547)..(548): n is a, c, g, or t
  misc_feature (554)..(554): n is a, c, g, or t
gcggccgcctactactactaaattcgcggccgcgtcgacctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctcctgagaaanaaaaaaaacaaaaaaaaaaaaanatnngggggngcgccggggccc

SEQ ID NO: 285298 - DNA, 308 bp, Homo sapiens
ccgtctgctcacccggcctgccctttcctgcctttcgtctgcagcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagtacccagcttagtgcttttagacttttaaccagacccttagacccccacagtaccggacctcaagcattcctaaagtaggcaggtgacatacgccttagccttttcacgaa

SEQ ID NO: 285299 - DNA, 1573 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgataatcttccaatggaaatccatggttcaagtgccacctcttcaggaaagccatctgacttcaatcaggcagcagtggatggtgcaggggaaagaggtgggaaggaggtcctgggagggacactggatgtcttaccccaagctgggccttgcagtacctgtggctggctgtgctggttgagcccgaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285300 - DNA, 1606 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcaggcagcagtggatggtgcaggggaaagaggtgggaaggaggtcctgggagggacactggatgtcttaccccaagctgggccttgcagtacctgtggctggctgtgctggttgagcccgaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285301 - DNA, 1489 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285302 - DNA, 1365 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatatcccagaggagacagacatcggatggctgataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285303 - DNA, 1259 bp, Homo sapiens
agggatcttggtctgtagcatcctttgtgggatctcattccaaggggcctctgtgtgtgtctcagattgggcctctcagtgttgagctcccttgattggttgcctccctcttcccccctcagcatacacactcctgattagacatgggtatggtggcagcagcccccagtattgagaggactaggaccctgggacccctgccgaacgagatctgtccaggcagctcctctccctgaccaagtgggggcgctcgtgtggctggcagggagcccgggtccagacctgagggctcagggcaagcggcctgattgggctgtctctggtcttcagaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285304 - DNA, 1207 bp, Homo sapiens
ggattcttgagacagacacgccacagaggggccaccagacttgaaggactccaagaaggaccttcaactgaagacctcctctcaagtagaggggtctccagatcgagggatcaccacagaggggtccctaagccacagacatttaaaaaggatcccggattgtgagacctacagaagagggggtttctggagctgaatctcctgcccccaccaaaactgagatgccgttgcctggtctgctgccccaagctcaacccctgtcctctccctctttccccatatgccccctccaggctgagactgatgtgataacaccaaggcagggaccttctgaaccattcctgcatcttggggctccctgactctccctctctgctccttctctcttccacaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285305 - DNA, 894 bp, Homo sapiens
tcggttcccggatctgactccgcggctcctgcatcttggggctccctgactctccctctctgctccttctctcttccacaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285306 - DNA, 1833 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtgagtctcatggctgaccctggagggaggctggagatcattttttcttcctgggctcccaggtccctcccccagagccagctcagacaggaattcaggaaggagctttggatgatcgagcaacagcgcgtgcaggagtgtgtgacggggtggacagaaaagagaatgcctcttccagccccacccgccgcaccccagggggttgtgagtgcctgtactaaacccgtcctggagcagggagtcagagacgccccgttccaggacccttgtcaccgggagacaggagcggggaggatctgtggggtcctgggttcagcactctgccctgctgccgctgaggagaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285307 - DNA, 2021 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtgagtctcatggctgaccctggagggaggctggagatcattttttcttcctgggctcccaggtccctcccccagagccagctcagacaggaattcaggaaggagctttggatgatcgagcaacagcgcgtgcaggagtgtgtgacggggtggacagaaaagagaatgcctcttccagccccacccgccgcaccccagggggttgtgagtgcctgtactaaacccgtcctggagcagggagtcagagacgccccgttccaggacccttgtcaccgggagacaggagcggggaggatctgtggggtcctgggttcagcactctgccctgctgccgctgaggagaggtaagggtggagcggggcagagaaaatgggtctgttcagacggagccagctctgaccacaggggacatttgccagaccctgtgcttctctgctgggaggagcggttagagtgtgtgtgggcggatgcgagtggccggagaccagggcccaacataaacaagctttggagacaaacaaccttatgacctgtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285308 - DNA, 2105 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgataatcttccaatggaaatccatggttcaagtgccacctcttcaggaaagccatctgacttcaatcaggcagcagtggatggtgcaggggaaagaggtgggaaggaggtcctgggagggacactggatgtcttaccccaagctgggccttgcagtacctgtggctggctgtgctggttgagcccgaatcgaccacggaaatttgacacctccgggcttggaagcagctctctcctccttccccgctgcttataaacctcagccctgaggctccagctcactctaccccatctccttgccgggtgagtctcatggctgaccctggagggaggctggagatcattttttcttcctgggctcccaggtccctcccccagagccagctcagacaggaattcaggaaggagctttggatgatcgagcaacagcgcgtgcaggagtgtgtgacggggtggacagaaaagagaatgcctcttccagccccacccgccgcaccccagggggttgtgagtgcctgtactaaacccgtcctggagcagggagtcagagacgccccgttccaggacccttgtcaccgggagacaggagcggggaggatctgtggggtcctgggttcagcactctgccctgctgccgctgaggagaggtaagggtggagcggggcagagaaaatgggtctgttcagacggagccagctctgaccacaggggacatttgccagaccctgtgcttctctgctgggaggagcggttagagtgtgtgtgggcggatgcgagtggccggagaccagggcccaacataaacaagctttggagacaaacaaccttatgacctgtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285309 - DNA, 1490 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcaggcagcagtggatggtgcaggggaaagaggtgggaaggaggtcctgggagggacactggatgtcttaccccaagctgggccttgcagtacctgtggctggctgtgctggttgagcccggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285310 - DNA, 1272 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285311 - DNA, 843 bp, Homo sapiens
agaggatcccagcgtcagcactcctggcgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285312 - DNA, 884 bp, Homo sapiens
gcggccgcctactactactaaattcgcggccgcgtcgacctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaaaaaaaaaaaaaaaaaaaaaaaaaaaaaaaaaaaaaaaaaaaaaaaaaaaaggggggggggggaaaaaaaatccccggggggggccccaatttggtataacccatttttttggtaaagaggggggcccaataagaggggcggggtattaaaaaaccgaaggacacgaggggacgggtaaacaaagcgcggggggggaaaattggtatgtggggaacttggggaaggaagaccccatgttggggggcgaatagtggggaacaccctgaggagatttagagcccgaggagatatacactttcacgttgagtgtgaaccacgcgaatacctcgtgaaaaattgcgacggattttagagattag

SEQ ID NO: 285313 - DNA, 1348 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccccaaaaaaaaaaacacacacacaacaaaaacctgggtgggccgcagcgcccgaagaagagtccttaaacccaccggtggggccgggggcccaaaggtattgaccactggccagcgcggcccccagggaaacccggcaggaagggcgggtcccccccataaaagcccgggggacacggcgcttcggaccaccaaagggccgggccacggccacacgggccaagggcgaaaa

SEQ ID NO: 285314 - DNA, 1152 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttggaaaaaaaagagacacaaccgaggcaaaacc

SEQ ID NO: 285315 - DNA, 1154 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggccagaaagactcctacgtgggcgacgaggcccagagcaagcgtggcatcctgaccctgaagtaccccattgagcatggcatcgtcaccaa

SEQ ID NO: 285316 - DNA, 1496 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtgagtctcatggctgaccctggagggaggctggagatcattttttcttcctgggctcccaggtccctcccccagagccagctcagacaggaattcaggaaggagctttggatgatcgagcaacagcgcgtgcaggagtgtgtgacggggtggacagaaaagagaatgcctcttccagccccacccgccgcaccccagggggttgtgagtgcctgtactaaacccgtcctggagcagggagtcagagacgccccgttccaggacccttgtcaccgggagacaggagcggggaggatctgtggggtcctgggttcagcactctgccctgctgccgctgaggagaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttggaaaaaaaagagacacaaccgaggcaaaacc

SEQ ID NO: 285317 - DNA, 1838 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtgagtctcatggctgaccctggagggaggctggagatcattttttcttcctgggctcccaggtccctcccccagagccagctcagacaggaattcaggaaggagctttggatgatcgagcaacagcgcgtgcaggagtgtgtgacggggtggacagaaaagagaatgcctcttccagccccacccgccgcaccccagggggttgtgagtgcctgtactaaacccgtcctggagcagggagtcagagacgccccgttccaggacccttgtcaccgggagacaggagcggggaggatctgtggggtcctgggttcagcactctgccctgctgccgctgaggagaggtaagggtggagcggggcagagaaaatgggtctgttcagacggagccagctctgaccacaggggacatttgccagaccctgtgcttctctgctgggaggagcggttagagtgtgtgtgggcggatgcgagtggccggagaccagggcccaacataaacaagctttggagacaaacaaccttatgacctgtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgacaaacaaacacacccaacataccaacaacaacacaacacggcgacacatatgtggggcgcggaacaacatgagactcaatccgccacggcattcaggtacgctccaggcccactccccgcgacaaccgggaattctgccgcgccatcatagaaggcgcaataaccagaacccgggaccggctca

SEQ ID NO: 285318 - DNA, 1265 bp, Homo sapiens
ggattcttgagacagacacgccacagaggggccaccagacttgaaggactccaagaaggaccttcaactgaagacctcctctcaagtagaggggtctccagatcgagggatcaccacagaggggtccctaagccacagacatttaaaaaggatcccggattgtgagacctacagaagagggggtttctggagctgaatctcctgcccccaccaaaactgagatgccgttgcctggtctgctgccccaagctcaacccctgtcctctccctctttccccatatgccccctccaggctgagactgatgtgataacaccaaggcagggaccttctgaaccattcctgcatcttggggctccctgactctccctctctgctccttctctcttccacaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaaaaaaaaaaaaaaccaacaacacaaaaaaacaaaaacaacacaacaacaaagaaacaacaaccaaaacacaccacaaaccacacaccacacccaaccccacccggctattaataaaaacacagaggaggggggggggtgatccaaataatatctaacgagggggggggaccaacccaacgaccagcacacccccagtatggttgtggcacagcaagcggcccccaacgatggacagagcattacatcgaacgacggcgaccgccgatctctaacaacagaccgcgcagcaagcacacagccagctccccacgcctctacgaacacaacaccctctgtgggtgacacacaacgcaacagccccccacacaatcaagccgcgcgcgcaacaaacaccgcgtgctgtcgacaccacaccgcgcgggg

SEQ ID NO: 285319 - DNA, 1172 bp, Homo sapiens
  misc_feature (1127)..(1127): n is a, c, g, or t
  misc_feature (1150)..(1150): n is a, c, g, or t
  misc_feature (1153)..(1154): n is a, c, g, or t
  misc_feature (1160)..(1160): n is a, c, g, or t
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcaggcagcagtggatggtgcaggggaaagaggtgggaaggaggtcctgggagggacactggatgtcttaccccaagctgggccttgcagtacctgtggctggctgtgctggttgagcccggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctcctgagaaanaaaaaaaacaaaaaaaaaaaaanatnngggggngcgccggggccc

SEQ ID NO: 285320 - DNA, 977 bp, Homo sapiens
  misc_feature (950)..(951): n is a, c, g, or t
  misc_feature (966)..(966): n is a, c, g, or t
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggtccagatgcannagttcaatgaactgnagcatctggac

SEQ ID NO: 285321 - DNA, 1135 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatgtaatgcaccttgacctctttctaaataagacacttccccaaataaggggagttgagagtgaacagtcttcacgtctccacccacttccagatcccagaggagacagacatcggatggctgttacctcctcctaaaatgtctgcatttacccagataatcttccaatggaaatccatggttcaagtgccacctcttcaggaaagccatctgacttcaatcagaatcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcgtagctcaagcataatcgcgaactgtagactcgatcgtcgagctcatgcaccacttactgatactgatacatctatcctttatttccctgccttagctctcatccaagaacaaatataactataccacaactccctatccatacaccctctctacgcctgcaacacactatctactatcactccacctcccc

SEQ ID NO: 285322 - DNA, 444 bp, Homo sapiens
gaggaaacagacgccagtgctcctcccggggctgccaccacggctccggcaggcgggccggggaccggccgaacctgagttgacggtggaggggctcggcggccgccagctcctgctcggtgtccaaaacaaaatggccgccacgtccagtgcttgtctgaccggctaaaatggcgtctacgcaattacgtcaggcgtcagatccgcgcacgactagagggcgggaaagatttgagctacgcctgcgcagagttgagaagctgatgtctcctcgacttccaactggaaccttgaacccccacatttctggaccttgagcattcctcaagtaggaagatatcccagaggagacagacatcggatggctggtgagagagaagcctttaatgaaagatgagttgcaggcttggaccgctactcttgcgcccttggtgggggtggggg

SEQ ID NO: 285323 - DNA, 466 bp, Homo sapiens
gcatcatgtgagtaggggtgcacagagcaaggacagaaacagcagtttacagaggaggaaacccaaaaggccaacatgcattatcaagaaagtaatcagagaaatgcaaatcaaaacaaagctgtcacttccacccactagagcagcagattaaacagctgggaggtgccaagtgttggcaaggctatggggaaataggagcccttgtgccctgctgatggaagtgtggactagcgcagcatcctggagagtagtcagtgccacttgcaaatcccacttctgcatgtgtaactcacagaaatcctcacgtatccaggtccataagggcacatggaccagactgttcatagcagcctcattaatgatgttaggaagctgcaggcaacgtaggtgtccatcactcggagactggacatgcacaccacggagtattatgcagtagccagaagcaacagattagatacac

SEQ ID NO: 285324 - DNA, 326 bp, Homo sapiens
agattatcaacagttctaatggtaaccatatattttggcccatggcgattctggaatgtatgtatttcgtgtgaagatcctggatccaaactatagtttctgtaacctaacagctatgtttgcaatagagacatttggactgattcccaggtgaatattaaggtatatacccacccaagtacccaccaaccgaagaaggagtcaagtgagttagccaggagaaagagcaaaggaggaggatctcactcacctgccccgctctcacctgccagcagctagagtccagcagccagggcatatgagcacagcatacaggatagtctggt

SEQ ID NO: 285325 - DNA, 718 bp, Homo sapiens
cccggctaattttttgcatttttagtagagacggggtttcaccatgttagccaggatggtctcgatctcccgacttcaggtgatctgcccgcctcggcctcccaaagtgccgggattacaggcatgagccaccacgcctggctcttgagacaaattctaatcccacaagctttagaatggtctctccttactttttaaaacatacacaccctatgattatgagtgatctagctccttcaggtcctcttctccaatttttacccccaagaaactccttaaacctctctggttaggccctagctcaataggatggaacgtttcccccactctgaatggtttctttctggaacttccatctgtaggtccagtggatttgtgcttcctcgcctccaagaatgaactcgctcactgctatccaagctccaagcccaatgggctgcggtgaattctcacactgatctctgtcaacttctcatccagtgggatctctcccccaccatctcccataatggtttcttcctaaggtgagttcgtgcttaggtgagctctcctaaggtgagtttgggcttccctctaagtgcagtggatctacatctcccagcattctatgggggggccccttgcttaataaccccaaaacaccgggtgtggtggctcacacctgtaatcccagcactttgggaggccgaggcgggcgaaccacgaggtcaggagttcc

SEQ ID NO: 285326 - DNA, 346 bp, Homo sapiens
cacggtgcaaggcatcgtccgtcactggaccactcccagccaaccttcacctcgttccatcagcgagttgagaagggatgcgttggagaagaagaacaagtagccaaaagtctgtcaacttctcatccagtgggatctctcccccaccatctcccataatggtttcttcctaaggctggtctcgaacttttggcctcaagcaattcttccaccttgacctcccaaagtgctgggattatgagagtcagccgcacgcctggcggggatcttctttctacaatggaatctccttaatgaagacagtgctttcctccaactttgaataaagtgaactattccctatttc

SEQ ID NO: 285327 - DNA, 1117 bp, Homo sapiens
ttggaagttttctcggtcgtgataatctccagcagctgcatcttgtccacgggagagaagtagtgcatgccaatcacctggcaaggggaaccaaaagccaacagatcggagaatgcggggtttttctctgttccgagtttaccttctcaggtcttttgctgacagcagcgatttcactgattgggagagcagatgtgttactggcaaagatacagtgatctggaatcacctgcaggggaaaagcatttaacaatgtgtcagatggttggatgagaaacgtggaagggacacctgtcaaatgtgtgcaaatctggaacaggcagaatcctaacagagatgagaatcaaggaggaagacacattcaacacactgaaaagctgagtacaaaataagattataatgcaataaaagtaaagtactgccttaagatttaaaaaaaaaaggaaagaaaagaactgtataggtacttgaaggacaagacctggcttggcagtatttgtgataaagatcccatgattttagttaatcaagagtggagggtgggcatggtggctaaacaactataatcccaacacttcaggaggccaaggatggaggattacttgaggccaggagttcaagaccaacctcggcatcatagtgagaccctatatctacaaaacataactttttttttttttttggagacaaagtcttgctttttcgcccaggctagagtgcagtggtgcaatctcagctcaccgcaagctttgccgcctgggttcaagcaattctcctgcctcagcctcccgagtagctgggattacaggcacctgccaccatgcctggctaatttttttgtagtttttagtaaagacagggtttcatcatcttggccaggctggtcttgaactcctgacctcgtgatccacccgcctcagcatcccaaagtgctgggattacaggtgtgagccacagtgcccggccctacaaaaaataactttaaaaaactagccaggcataccactatagttgcagctacagtacacaaatactattaactattagctttatccacctggagaatagtctctaatgcagattgtctccgcattctggccacgatcccaacttattc

SEQ ID NO: 285328 - DNA, 657 bp, Homo sapiens
gcctttacccaaaagggggaacccctttcccaaaaaaaaaaaaaaaaaaaaaaagagtgcacaggcaagggctcctcccatgaagaggaccggacagatggagaccattcttcttgtgccccaagactggggctcctatgccttacctgctttctaaggcactcctgctggattttggtggcaaatctgggtagtcatttttcattccgcaggactcctccttactcacagttgagccaaggacagccaagtgacctgtgacataacattgttcgcaaaatgagctggaacagaaaacagtgtcttgatcctaccacttgtttctcttctcctccccaggacatcatgacctccagtgtgcattcaacctaacagagctgctaaactcattgcctttctgctctgcctctcctctctcctgcaacaccctctctgtctcataaatatagtcacaattttctcatggtttaagccaagaaacagttaaaaactctaaagtcttttatccaatgcattaaaaaactgagatactaaattagataagttgttatccggtagaactcacgaaagaatcaaatgttctcgacaaaatttagaacaaaatttgaccctggaaaatggaggtgatagaaataaagtccacaaaaggaaacttgc

SEQ ID NO: 285329 - DNA, 476 bp, Homo sapiens
gagggctctgggtgtcctccgattcagttctgacactctctacctaaagaccgcgtcagatcccagaggttgagggctcagtctcacaagactgccccccgacttccgccgccaaccgcaagcccctggttgttttacctgtgcttctgaccaagcaggacatcatgacctccagtgtgcattcaacctaacagagctgctaaactcattgcctttctgctctgcctctcctctctcctgcaacaccctctctgtctcataaatatagtcacaattttctcatggtttaagccaagaaacagttaaaaactctaaagtcttttatccaatgcattaaaaaactgagatactaaattagataagttgttatccggtagaactcacgaaagaatcaaatgttctcgacaaaatttagaacaaaatttgaccctggaaaatggaggtgatagaaataaagtccacaaaaggaaacttgc

SEQ ID NO: 285330 - DNA, 2843 bp, Homo sapiens
  misc_feature (3)..(3): n is a, c, g, or t
  misc_feature (5)..(5): n is a, c, g, or t
  misc_feature (151)..(151): n is a, c, g, or t
  misc_feature (192)..(192): n is a, c, g, or t
  misc_feature (690)..(690): n is a, c, g, or t
ggnancacaggttggccaggtgcccgtcacaccagccccaagtgccccaggggtcgtgcagacctgtccaggtgtgctgctgaccagcagggctggccgctcatggagacgcatcaccagcccgctcccagcatcctgctccatgaaggcngaccgctccatggctgggtcctcaggttctgagctgaaggnggagaaaaaaaccctgtgagaggccacagagcaggcccaggacccagaacgggcatctcctgccatggcaaggcctgcaggctcccaacggttggggtgcccagccgcatcagcagcaccaggccacccctgccaatcgaggcatgggcttgctttctctaatattgtttctgggtgctaaggttacaacagcaaacaagactgactcattccttttctccacgggacttactgtcttatcatcccctggactcaagatgagggtgctaggatgccctcccacaccaccccagcttacccaggggcacacctcagggtatgtggacctgcacaaaggtcccttccttagccccatgagacaccccaggggacacacaggtccacagatcctgccacaggcctgggaacccattggcaggagagtaagacagtgcaggggtccacaaacatttcttaaggggccagagagtaaatacttcaggctttgcaggccagacnttctctgttgcaaaacgcaattctgctattgtagctcaaaggcggctatagacaactcagaagttaatgagtgtgttgtgtcccaatgaaacttgatttacaaaagcaggagactggcctgtagccttagtttgccaacccctggatgagtgggttcccaggtctgcagtgagaaggggagaggccagggcagtggcgagcaggagagaaggcagctgaggatgggaggcctaccaggccctgaacagagagtgcgtgctgcccaccttcatgaggagccggtgctgcaggtccagaggtgcctctttaaagaaagatgccagcttgtcgtagacggtcacagccctgcaatgaaatcatggcaggactattgcattagtccagcgtggaggctactttctgctcaaaccactcatttgggtcccgtgcccaacgtcacccatcctcagcaaaaccaccattatttccttctgcctggtttccagaaagttcccctaaagccctgaggaatcaccgaatgaaaggggctttttacaaacaggaaacttaagtggagtgccaatacacaacatggattgcagcaggctcggtctaagataaaaccagacggtggacaacaggccaggtaagacccacatggtctgcactccctggttctgttattgtgtggaggaatgtcttagtctgttgctcctgtgggtgtagctaaagcacaaaccaggagtcctcatccttagaaagcagttagacagacatctgagaaccaatcccaaactgcagccttccacagaaccttctggaaccttctggaatgcaacttattactgccagagggtctttgatgagagtctactctccaccatttgtcttcagagagaatacccacctattctctttccgtggaaaggtaagttattggagtttatgcagtctggtatattaattgagagctttacttcaaagaatgtcacgtttatggttcagtctcacagactgggttaaaaaggcagtgttgactattaagttgtaaattactatgatgatcattattattgaagcaagctgtgagaaatgagcattatcttacaatatctgcattttagtgaacctgaaggaagagtgtattgctggaattacagaagcctgagaaccacaggggaattctcactgcagggtattcagggtcaaaagctgattctattttgcatgctcaatccttcgtcaatttatttttatttctttctttattttttgagacagggtcttactctgtcgcccaggctggaaggccttggtgcaatctcagctcactgcaacctcgcctcccgggttcaagtgattctcctgcctcagcctcccacgtgactgggattacaggtttttgcttgtctgatgactgatggctccacccagacctgccaaccactcccgcggccccatccagaagtggctcagcgtgcatgaggaccatctccaacatccctgtgattgtacccccaaccaaccagcagcaagaacctattgcctagtcacctcccctctctttccccaactatcattgaaaaagtctggcttccaaattttccgggagactgatttgggtaataataaaactccagtcttctgttcagccagctctgcatgaattaagctctttctctattgcaattttcctgtcttgataaattgtctctacctgggcagggggcaaaatgaacccatagggtggttacagtaccttgctgggtcacttgatattcctggagggtcacgggaagcgctatgtgaatcccacttctgatattgtaagattctctccagggcctgaaagcttaaggggttgagcaactcctcccttctcaggcccagccccagggcgcaaggccgcttgcatcagcagcgtgcgtgagcagatgcgccagcaagatagcaaaagcaggaagagagccagccggaagacaagtacctctgaagatggagaaagaggccatctgggtacaacgttgcagttacgtcagaccaggacacttcctgtttacaggagactataaaacctttgccccatcctcacttggggctgacgccgttttaggcctcagcccgccagcacccaggctctcattaaaacagcatgttgctccacaatgtcgtgt

SEQ ID NO: 285331 - DNA, 943 bp, Homo sapiens
tatagctgtccagggcactagctgtatacgtagtcacgacgtaatatggcatgactattgcattagtccagcgtggaggctactttctgctcaaaccactcatttgggtcccgtgcccaacgtcacccatcctcagcaaaaccaccattatttccttctgcctggtttccagaaagttcccctaaagccctgaggaatcaccgaatgaaaggggctttttacaaacaggaaacttaagtggagtgccaatacacaacatggattgcagcaggctcggtctaagataaaaccagacggtggacaacaggccagaaccttctggaaccttctggaatgcaacttattactgccagagggtctttgatgagagtctactctccaccatttgtcttcagagagaatacccacctattctctttccgtggaaaggtttttgcttgtctgatgactgatggctccacccagacctgccaaccactcccgcggccccatccagaagtggctcagcgtgcatgaggaccatctccaacatccctgtgattgtacccccaaccaaccagcagcaagaacctattgcctagtcacctcccctctctttccccaactatcattgaaaaagtctggcttccaaattttccgggagactgatttgggcccagccccagggcgcaaggccgcttgcatcagcagcgtgcgtgagcagatgcgccagcaagatagcaaaagcaggaagagagccagccggaagacaagtacctctgaagatggagaaagaggccatctgggtacaacgttgcagttacgtcagaccaggacacttcctgtttacaggagactataaaacctttgccccatcctcacttggggctgacgccgttttaggcctcagcccgccagcacccaggctctcattaaaacagcatgttgctccacaatgtcgtgt

SEQ ID NO: 285332 - DNA, 1578 bp, Homo sapiens
tatagctgtccagggcactagctgtatacgtagtcacgacgtaatatggcatgactattgcattagtccagcgtggaggctactttctgctcaaaccactcatttgggtcccgtgcccaacgtcacccatcctcagcaaaaccaccattatttccttctgcctggtttccagaaagttcccctaaagccctgaggaatcaccgaatgaaaggggctttttacaaacaggaaacttaagtggagtgccaatacacaacatggattgcagcaggctcggtctaagataaaaccagacggtggacaacaggccaggtaagacccacatggtctgcactccctggttctgttattgtgtggaggaatgtcttagtctgttgctcctgtgggtgtagctaaagcacaaaccaggagtcctcatccttagaaagcagttagacagacatctgagaaccaatcccaaactgcagccttccacagaaccttctggaaccttctggaatgcaacttattactgccagagggtctttgatgagagtctactctccaccatttgtcttcagagagaatacccacctattctctttccgtggaaaggtaagttattggagtttatgcagtctggtatattaattgagagctttacttcaaagaatgtcacgtttatggttcagtctcacagactgggttaaaaaggcagtgttgactattaagttgtaaattactatgatgatcattattattgaagcaagctgtgagaaatgagcattatcttacaatatctgcattttagtgaacctgaaggaagagtgtattgctggaattacagaagcctgagaaccacaggggaattctcactgcagggtattcagggtcaaaagctgattctattttgcatgctcaatccttcgtcaatttatttttatttctttctttattttttgagacagggtcttactctgtcgcccaggctggaaggccttggtgcaatctcagctcactgcaacctcgcctcccgggttcaagtgattctcctgcctcagcctcccacgtgactgggattacaggtttttgcttgtctgatgactgatggctccacccagacctgccaaccactcccgcggccccatccagaagtggctcagcgtgcatgaggaccatctccaacatccctgtgattgtacccccaaccaaccagcagcaagaacctattgcctagtcacctcccctctctttccccaactatcattgaaaaagtctggcttccaaattttccgggagactgatttgggcccagccccagggcgcaaggccgcttgcatcagcagcgtgcgtgagcagatgcgccagcaagatagcaaaagcaggaagagagccagccggaagacaagtacctctgaagatggagaaagaggccatctgggtacaacgttgcagttacgtcagaccaggacacttcctgtttacaggagactataaaacctttgccccatcctcacttggggctgacgccgttttaggcctcagcccgccagcacccaggctctcattaaaacagcatgttgctccacaatgtcgtgt

SEQ ID NO: 285333 - DNA, 1829 bp, Homo sapiens
  misc_feature (3)..(3): n is a, c, g, or t
  misc_feature (5)..(5): n is a, c, g, or t
  misc_feature (151)..(151): n is a, c, g, or t
  misc_feature (192)..(192): n is a, c, g, or t
  misc_feature (690)..(690): n is a, c, g, or t
ggnancacaggttggccaggtgcccgtcacaccagccccaagtgccccaggggtcgtgcagacctgtccaggtgtgctgctgaccagcagggctggccgctcatggagacgcatcaccagcccgctcccagcatcctgctccatgaaggcngaccgctccatggctgggtcctcaggttctgagctgaaggnggagaaaaaaaccctgtgagaggccacagagcaggcccaggacccagaacgggcatctcctgccatggcaaggcctgcaggctcccaacggttggggtgcccagccgcatcagcagcaccaggccacccctgccaatcgaggcatgggcttgctttctctaatattgtttctgggtgctaaggttacaacagcaaacaagactgactcattccttttctccacgggacttactgtcttatcatcccctggactcaagatgagggtgctaggatgccctcccacaccaccccagcttacccaggggcacacctcagggtatgtggacctgcacaaaggtcccttccttagccccatgagacaccccaggggacacacaggtccacagatcctgccacaggcctgggaacccattggcaggagagtaagacagtgcaggggtccacaaacatttcttaaggggccagagagtaaatacttcaggctttgcaggccagacnttctctgttgcaaaacgcaattctgctattgtagctcaaaggcggctatagacaactcagaagttaatgagtgtgttgtgtcccaatgaaacttgatttacaaaagcaggagactggcctgtagccttagtttgccaacccctggatgagtgggttcccaggtctgcagtgagaaggggagaggccagggcagtggcgagcaggagagaaggcagctgaggatgggaggcctaccaggccctgaacagagagtgcgtgctgcccaccttcatgaggagccggtgctgcaggtccagaggtgcctctttaaagaaagatgccagcttgtcgtagacggtcacagccctgcaatgaaatcatggcaggactattgcattagtccagcgtggaggctactttctgctcaaaccactcatttgggtcccgtgcccaacgtcacccatcctcagcaaaaccaccattatttccttctgcctggtttccagaaagttcccctaaagccctgaggaatcaccgaatgaaaggggctttttacaaacaggaaacttaagtggagtgccaatacacaacatggattgcagcaggctcggtctaagataaaaccagacggtggacaacaggccaggtttttgcttgtctgatgactgatggctccacccagacctgccaaccactcccgcggccccatccagaagtggctcagcgtgcatgaggaccatctccaacatccctgtgattgtacccccaaccaaccagcagcaagaacctattgcctagtcacctcccctctctttccccaactatcattgaaaaagtctggcttccaaattttccgggagactgatttgggcccagccccagggcgcaaggccgcttgcatcagcagcgtgcgtgagcagatgcgccagcaagatagcaaaagcaggaagagagccagccggaagacaagtacctctgaagatggagaaagaggccatctgggtacaacgttgcagttacgtcagaccaggacacttcctgtttacaggagactataaaacctttgccccatcctcacttggggctgacgccgttttaggcctcagcccgccagcacccaggctctcattaaaacagcatgttgctccacaatgtcgtgt

SEQ ID NO: 285334 - DNA, 921 bp, Homo sapiens
aaagacaaattcaacatcatatactttgtgacactccctccaggacgactaacgtcttcaatgactgcacctcttatttccataatcattatctttttgtactaactgcattatttttacttgaacaaaaaggttgtaattcccgcctcacggttccgagtcatgatacaactgatctcctgtttccctagcatgcaaccttccggaaaccgctttgtttccctatttgtcggacactgacttcagggaggcccggtcggcctctttggtgagcacggtgttgagctgatcactggtgcgcccttaataacgccggcgggactcaccccaatccgaaacccaccatcccgacgtgcttttgagtggcgttctgcccgttcttaacgcgcgagctactgcacgctattctcacagccgggatgggcttctttaaccacgtgaagtacttgtatgaactatgaaaataaaccctggattggcttttctgaggaagttcaagcacctaattaacccctggtggagaaaaagccacgcactctcacgcgattggagatcagagttggagcctgagggtgaaagcctcatgctgagaagagtggagcgggaagataaagcatggcaacattgatgacaccctaggcctaatacaccagccctgacctgcttaccttctctcatttgtaggctatgtagtccagtcacttttacgtgcagctgagtacaaccctaaatgatatatcaatcgcttcagtgaccatttatatgtcaatagcttgcacatttattatttgcaaccaaagtatctctggaggtactcatgtgcatatacagtattactggaaacttctacttggatatcctccaggcaactcgaatattttaacatggccaaagcacatcttgtcctccaacctactcccc

SEQ ID NO: 285335 - DNA, 423 bp, Homo sapiens
gtaatgacatgatcctttattgtcaatatgcttacagtccactagggggagccaaatatataaataagcttaagaattacgttgaaggggccagaatagaagtctgtggaaggtgtgggatgggatgacagcatcagaaagaattgggcaaatctgtcccaggactaggtcagaaaaacgcctccctagggaaggtgccaccccaaacacgtgtttctgagaccccttacccgaaataaggaggctgccaaggtgagcatggaacggttaggcgttttgtatggagcaaactggggggaccccagctgagacctctggcctgggccttgtgattcacgcataggctcatcttatcggccaccgggtctgagaagaaactaccaccctgcaagttaacagggatccctccgagaacgggcacct

SEQ ID NO: 285336 - DNA, 1050 bp, Homo sapiens
gtaatgacatgatcctttattgtcaatatgcttacagtccactagggggagccaaatatataaataagcttaagaattacgttgaaggggccagaatagaagtctgtggaaggtgtgggatgggatgacagcatcagaaagaattgggcaaatctgtcccaggactaggtcagaaaaacgcctccctagggaaggtgccaccccaaacacgtgtttctgagaccccttacccgaaataaggaggctgccaagcgatacttgaggttggaccagatgatgttttcttgagagaagcagaaaacgccaagtcggcctccacgcattgtggtgtctatggtgacgccagagtcagccaccaactcagagccttcataaaatcgtaccctgcggacaacacggccggaggggcctccatgaaatccaacccggggttccccatcctgcggtcacaaaagtcctggcatgtccttggggactatcctaggtcagaattgctcagggaaatgaaggctctgggatgcagaacggagaatgctttgcttctagagcaaggaaaaatacttgtattgagcatcatgaagttcgtgttactaacctcacaggcaatcgacagcctgggagatagtccctagggcttcagatcttgtgtggtgttcatcccaccatcttcaggcccacagtgtgtcatttttccacctctgctttgttaggtgctggagagatcaggcgcatggtgagtcgcttctgcctgggccagtgtcacacagagactacccttttctgcagttatccagaggtagcttcaaaggacggattctgggagacttaaaaatgaacagctctcagagttttgtgtttgatgatgtcacattggtagcttgaaatcagcaatgaggacaatgcggagttacatcatggaaactggaaaatgctaccaactagggctttctgtgatttgcttaccagcatataccactggaaatgggtcatcagttaggcttgcagaagcctcccctccccagaccagctccgtggctggagaatgcacag

SEQ ID NO: 285337 - DNA, 410 bp, Homo sapiens
agaaactgccagctaccggaaggaaaacatcgggtatagtcgatcagtgattcagaacagaagcagagtatcatcggcaacattttccaaattgctgaaaatcagcagattccatactattaacattgtactttaaatcagttcactctcacctacaatgaacacatctaactattaaacatccatcttcgtgccatttaaaattgcgtccaacagcaagagccacagtggcaaacagaaacattttacatgcttgtcagactggactctcttctaatgggcaagaaccgcacactacactgaagttttgaaagaccaaagtgccaatagtaaagagtagaacttaaattccttaagttcaaaagtgtctaaagaaaaactctgcggcccagaagatccaagttggcacc

SEQ ID NO: 285338 - DNA, 1539 bp, Homo sapiens
tgcggccgcggcctgcaggagcgcggcgaggcactggccgcctacctggacggccgtgagccagtcctgcgcttccggccgcgcgaggaggaggcgctgctgggcgagatcgtgcgcgccgcagccgccggctcgggagacctgccgcccctcgggcccgccacgctgctggcgctgtgcgtgcagcattccgcccgtgagctggagctgggccacctgccacgactgctgggccgcctggcccggctcatcaaggaggccgtctgggaaaagattaaggaaattggagaccgtcagccagaaaaccaccctgagggggtccccgaggtgcccctgactcctgaagctgtgtctgtggagctgcggccactcatgctgtggatggccaacaccacggagctgcttagctttgtgcaggagaaggtgctggaaatggagaaggaggctgaccaagaggacccacagctctgcaatgacttggaattatgtgatgaggccatggccctcctggatgaggtcatcatgtgtaccttccagcagtctgtctactacctcaccaagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggca

SEQ ID NO: 285339 - DNA, 2362 bp, Homo sapiens
ggcagggccaaccctacccagatctcctcccccaggcctggtctcctcacaggacgccccctccccgctcttcctgccgggtttcctcttgccttttcctgtcccccacccagtgctgggagccgtggcagaggcaagagcagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggca

SEQ ID NO: 285340 - DNA, 2392 bp, Homo sapiens
ggcagggccaaccctacccagatctcctcccccaggcctggtctcctcacaggacgccccctccccgctcttcctgccgggtttcctcttgccttttcctgtcccccacccagtgctgggagccgtggcagaggcaagagcagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacagactctaaccgcgccgccttcggcctcacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggca

SEQ ID NO: 285341 - DNA, 2214 bp, Homo sapiens
ggcagggccaaccctacccagatctcctcccccaggcctggtctcctcacaggacgccccctccccgctcttcctgccgggtttcctcttgccttttcctgtcccccacccagtgctgggagccgtggcagaggcaagagcagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggca

SEQ ID NO: 285342 - DNA, 2821 bp, Homo sapiens
ggcagggccaaccctacccagatctcctcccccaggcctggtctcctcacaggacgccccctccccgctcttcctgccgggtttcctcttgccttttcctgtcccccacccagtgctgggagccgtggcagaggcaagagcagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggcaaaaaaaaaaaaaaaaaaaaaaaaaaaaaaaaaaaaaaagacacaaaacagaaagggggggggaggcacaaaaagaactcccagcagggggggctcgcacattgaccagaccaaccagaatatgaggaaacagaggaggggccccaacagagagaagccatataaaaaaagagagggagatgacggagagataaaaaccccggagcagggaaacacgcggaccacacgagagaaacccttgggaaaagaaacaccccacaaaaagacgcggggggggacacacaagggggaaaaaacacccaaagaagagagtaaaacagcccacacagggagaaaaacaaccaatcaacgggtataacagcgtggcggcaacagacagcagaacatatacgacgccggagagaaaaagcagtcgacacggaggaaaatgacacaagacagacataattacaaccgcggc

SEQ ID NO: 285343 - DNA, 1024 bp, Homo sapiens
gggagttgtagtccaatcacttgtttccacttctctattttctcagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggca

SEQ ID NO: 285344 - DNA, 1859 bp, Homo sapiens
ggcagggccaaccctacccagatctcctcccccaggcctggtctcctcacaggacgccccctccccgctcttcctgccgggtttcctcttgccttttcctgtcccccacccagtgctgggagccgtggcagaggcaagagcagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggtgactcctggtcagctatacctgacccctgacctctgactcctcaacccccctcagc

SEQ ID NO: 285345 - DNA, 248 bp, Homo sapiens
caggcactggagatgagagaagggaatgagcccttttggagcttaaggagagacagaccttaactaatgacacaataaacttaataattacaattgaatcaggaacaatggacaagtaatgcaagacgctatgacaggtagataggggactgatgccagcttctccttggtggaaggtgggaagtgaccttccctggattaccagcactttaaaacccacacttctgcttctgccttacctggccact

SEQ ID NO: 285346 - DNA, 525 bp, Homo sapiens
gattacaggcgtgagccaccgcgcccggcccccaacgtttctttttaagcctgtcatatctcacattaaatgtgtaagtctctgaactgtagggctttgaacaaaggaaagttccatgagaatactatatgatgccaatttctactgttaggaacgcgataacagagtgcagtgggggagaaaataccgtcctcaagatctgagaaactggagaggaaaagtcacaggacaaccaacttctctatgacatagcccagcatctgaggaaagtcctgcaatagtggaggtggagcagagggtatgagctgggaagcaaatggagcaggagctggaggctgccccatccactccaagccagagaacaagcagaggctgccacaggagatcctgggcaagtaatcagccacagcatctagattagcatgaaggaaacactggccaaattaaaagatgaaacttccaaaaggtaaatctctgtgtattcatgcctaatcttccaaggttgtgtaaataatttttttctac

SEQ ID NO: 285347 - DNA, 1535 bp, Homo sapiens
aagagtctatacttctttaattattgcccttgtttttagtatttcagggttggtccacaggactcagggaaggagaaaaaagtataaaaatttcttttcttattacaagaattccaagatgtgtcagagttgaccagaagcatagagaaaactacatagtcgagtacccaccaggggaatgtggtagaattggcagtctgttggtctctttgtaatgtcagattaaagaaatcacctggaggctgacattggccccttcccttcccaggaggcagatctggcctaaatacggagatgcgtacaaagaagacctaggatcacaatcgttcttagccatcaaactcttcttccaggtcctagagaaagtggccactctataccaaagccaaagaactgcagagtactcctcttggttggggtttcatattgctcttgcaattcagtttcctctcatctttgctgtcatttcgtgggtaccaacagccttggccaggtgtgagaagtgtccattactattgtttgctctgactatcttgcgcaaagatgccaagtaaggctggagcaaaggccttggtgatactcttgccttggacagataaatggtggtagtgtagctagtccctcagttgcacctgtttgtattccaaaggcagtaaacacagatgttcagaagccctttataatcaagatgtcaaatatctgaaattattccccagctctgacaaaacttgccttctgggtgtggagacaaaacaagaatttgtgactactgctgatcacatctagaactgccttgaggctggccatgaagacttgaaaccacaattttcactgaggatctaaacctcagatcacatttgtttggggctactgtggggtaaggggatattaaggatgtaaaagggatgttgcaaatgctcatgagaccaggttttgtggcacgctagggccaccactaattctccatgatgacttctccacaggacttgcttaagcacaggcacaggacccaccaataatcagatgtgcactctacacagactgcacccaccgagaacaggtcacagtcctgtgacacaaacccatatacacaaccgagaggttggcattttggtccatgcttatttaacaaattcccttctgctgtgggcactaggacagggggctggcaatactcagatgagctgtcccacccccaagtccaaagcagcagctctcaggcctcctctgctgcctcatgccattccaaacatgatggctgggcttacacacctatcttactggaagcctccctctctgtgttccctttccaccactattccattacttccacaggagctggaggctgccccatccactccaagccagagaacaagcagaggctgccacaggagatcctgggcaagtaatcagccacagcatctagattagcatgaaggaaacactggccaaattaaaagatgaaacttccaaaaggtaaatctctgtgtattcatgcctaatcttccaaggttgtgtaaataatttttttctac

SEQ ID NO: 285348 - DNA, 1481 bp, Homo sapiens
aagagtctatacttctttaattattgcccttgtttttagtatttcagggttggtccacaggactcagggaaggagaaaaaagtataaaaatttcttttcttattacaagaattccaagatgtgtcagagttgaccagaagcatagagaaaactacatagtcgagtacccaccaggggaatgtggtagaattggcagtctgttggtctctttgtaatgtcagattaaagaaatcacctggaggctgacattggccccttcccttcccaggaggcagatctggcctaaatacggagatgcgtacaaagaagacctaggatcacaatcgttcttagccatcaaactcttcttccaggtcctagagaaagtggccactctataccaaagccaaagaactgcagagtactcctcttggttggggtttcatattgctcttgcaattcagtttcctctcatctttgctgtcatttcgtgggtaccaacagccttggccaggtgtgagaagtgtccattactattgtttgctctgactatcttgcgcaaagatgccaagtaaggctggagcaaaggccttggtgatactcttgccttggacagataaatggtggtagtgtagctagtccctcagttgcacctgtttgtattccaaaggcagtaaacacagatgttcagaagccctttataatcaagatgtcaaatatctgaaattattccccagctctgacaaaacttgccttctgggtgtggagacaaaacaagaatttgtgactactgctgcactgaggatctaaacctcagatcacatttgtttggggctactgtggggtaaggggatattaaggatgtaaaagggatgttgcaaatgctcatgagaccaggttttgtggcacgctagggccaccactaattctccatgatgacttctccacaggacttgcttaagcacaggcacaggacccaccaataatcagatgtgcactctacacagactgcacccaccgagaacaggtcacagtcctgtgacacaaacccatatacacaaccgagaggttggcattttggtccatgcttatttaacaaattcccttctgctgtgggcactaggacagggggctggcaatactcagatgagctgtcccacccccaagtccaaagcagcagctctcaggcctcctctgctgcctcatgccattccaaacatgatggctgggcttacacacctatcttactggaagcctccctctctgtgttccctttccaccactattccattacttccacaggagctggaggctgccccatccactccaagccagagaacaagcagaggctgccacaggagatcctgggcaagtaatcagccacagcatctagattagcatgaaggaaacactggccaaattaaaagatgaaacttccaaaaggtaaatctctgtgtattcatgcctaatcttccaaggttgtgtaaataatttttttctac

SEQ ID NO: 285349 - DNA, 1884 bp, Homo sapiens
ggttggccggggagagcgaagcgccgcccacgcggctgggaaagcttggggtggcgctggcgggaggtggggccgggggcgggttcctggcggagggtggggcagacgtgggttaccgggtgtgccaaccaaaccctgaacagaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggct

SEQ ID NO: 285350 - DNA, 1988 bp, Homo sapiens
aaaccctcaaggggttgcaggttcagctttcacttagagacagcaactccaaattcagggtcgctggggaaactaaggcaggactggggactctgagtgagaggtcagacgctggtcgcggactctttctcccgagaactggggatagctcttccgatagcccaaagcgattcatgcggatcctagaagaaagcgccgagaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaactgactgcttctgtgtcctttgtacaagtttatat

SEQ ID NO: 285351 - DNA, 694 bp, Homo sapiens
caaggtagaatgagaatttttactttttgacatggatgctttttctctgcagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaactgactgcttctgtgtcctttgtacaagtttatat

SEQ ID NO: 285352 - DNA, 2156 bp, Homo sapiens
ggttggccggggagagcgaagcgccgcccacgcggctgggaaagcttggggtggcgctggcgggaggtggggccgggggcgggttcctggcggagggtggggcagacgtgggttaccgggtgtgccaaccaaaccctgaacagaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggcccccttcttctctagtcactgcccctagggaccttgggcctcagccggcgaccctggagaaggtgcaggggagagggagcggcttccgcaagctctggcctccccacctctccaagtgaagcccgctaggcaggtgatcccgggctccggacgccggatcctggggacactgcttcacctgcgctcaacggtcacatcttcgctctccccgcaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaactgactgcttctgtgtcctttgtacaagtttatat

SEQ ID NO: 285353 - DNA, 1680 bp, Homo sapiens
aaaccctcaaggggttgcaggttcagctttcacttagagacagcaactccaaattcagggtcgctggggaaactaaggcaggactggggactctgagtgagaggtcagacgctggtcgcggactctttctcccgagaactggggatagctcttccgatagcccaaagcgattcatgcggatcctagaagaaagcgccgagaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgtgagttccttgctttttccaatttcatcaagacttgttcatatattaagatacacttcctggaagctgggggcttttcaggggcaatgaaattgaaggtgacaactctctgctcctggcaggcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtaaggacaggacccagcctggctttccagctctactggccattaaccccctgctaaccatccatacacctgtgtttataaagtgactaagcaaagtgacaaggaaacctgtttgaagggaaaaattagtctgtatcatttggtagaatgagaagggaagttacttcccttctttttttggggggacagtctagtccagcccaggcaacaagagcgaaactccgtctcaaaaaataattaaataaataaataaaccc

SEQ ID NO: 285354 - DNA, 1738 bp, Homo sapiens
gcaaggaaaaaaagaagagagaagaagaggaggaagcggaaataacggcggaggtgcgaggcctgggtggagccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaactgactgcttctgtgtcctttgtacaagtttatat

SEQ ID NO: 285355 - DNA, 1503 bp, Homo sapiens
gggtcagtagcaggacgctagtgacgcgcttgtacctagcgcgccaacgcttcctcagcgtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaactgactgcttctgtgtcctttgtacaagtttatat

SEQ ID NO: 285356 - DNA, 959 bp, Homo sapiens
ggccggaagtgcgtgggctgccgggctggcccagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtacttta

SEQ ID NO: 285357 - DNA, 1117 bp, Homo sapiens
ggccggaagtgcgtgggctgccgggctggcccagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagtttacccagtgatgatttaataaaattatgaaaaatcaggagagggagataattagttgcttcctccttcacactgtttgaatcga

SEQ ID NO: 285358 - DNA, 1070 bp, Homo sapiens
ggccggaagtgcgtgggctgccgggctggcccagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagtttacccagtgatgatttaataaaattatgaaaaatcag

SEQ ID NO: 285359 - DNA, 667 bp, Homo sapiens
ggccggaagtgcgtgggctgccgggctggcccagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgagatgttggaaggggccataagatgttggaaggggtcatgagatgttggaaggagcgatgagatgttggaaggagtcatgagatgttggacggggccatgagatgttggacggagggctgagatgttggaaggagcgatgagatgttggacggggcctgcgatgttgacaggcgcgatgagatgtcggaaggggggatcctc

SEQ ID NO: 285360 - DNA, 479 bp, Homo sapiens
ttttctggtaggctgtggttcccattacacccaccaggattagcagcattaggcagagtcccatggacagccttaggtgggtcatggagggattatggtctgaagtaaccagcaacctaggaacatagaaggtaatatttggcatggaataatgcctagccttagtagataaagcggcattacctttttttttttttttttttggagacaaggtcttggtctccactgcattccagcctgggtgacagagcgagaccctgtctcaaaaaagaagaagaaaaaggtggggggaggggactaagatccctatgtcctagagatgggggaatgtgttattgtatgggaggagggagtcaggtagtgacgggactggatgatcgtgttagggatctttgttctctgaaacgcaaccctgtctaggacaatatacacgtgagtgagtgcttaataaatttaatttcaaacatccggactccatg

SEQ ID NO: 285361 - DNA, 506 bp, Homo sapiens
tagcaggtgttcctattctgtaagtttgctttacaacaatacgaaaataagtgacaatttacaggttgaacaatttatttttgtaccaaaataaagaatggatctttagaactgtaaaacttcacccttttttcattgccaggctatataatattgacaaccggggaaagaggcattccaaagaaagtagaaattaagtatacacaatagattttccatccagttgtctcacaagaaattattctcttcccactgcattccagcctgggtgacagagcgagaccctgtctcaaaaaagaagaagaaaaaggtggggggaggggactaagatccctatgtcctagagatgggggaatgtgttattgtatgggaggagggagtcaggtagtgacgggactggatgatcgtgttagggatctttgttctctgaaacgcaaccctgtctaggacaatatacacgtgagtgagtgcttaataaatttaatttcaaacatccggactccatg

SEQ ID NO: 285362 - DNA, 429 bp, Homo sapiens
tagcaggtgttcctattctgtaagtttgctttacaacaatacgaaaataagtgacaatttacaggttgaacaatttatttttgtaccaaaataaagaatggatctttagaactgtaaaacttcacccttttttcattgccaggctatataatattgacaaccggggaaagagccactgcattccagcctgggtgacagagcgagaccctgtctcaaaaaagaagaagaaaaaggtggggggaggggactaagatccctatgtcctagagatgggggaatgtgttattgtatgggaggagggagtcaggtagtgacgggactggatgatcgtgttagggatctttgttctctgaaacgcaaccctgtctaggacaatatacacgtgagtgagtgcttaataaatttaatttcaaacatccggactccatg

SEQ ID NO: 285363 - DNA, 1055 bp, Homo sapiens
ggccggaagtgcgtgggctgccgggctggcccagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcgcgcaggggttctcagatgccgagagcatgtgtaaactacagtccagtgctgggctcataagacgtgctaggtgtagtaccatcggttccgagatataagaactgcacaataaacagtagcatttgagtaggtatgacgtggattcacatcgattggttccacgcatctcgtatcagaatcgtagcgtatagtgtgcactagtttaattggtgggtgactgta

SEQ ID NO: 285364 - DNA, 1801 bp, Homo sapiens
tctcgaacacctgggctcaagcgatcctcttgcctcggcctctcaaagtgctgagattactttggaagtgcaagaaccaccgcgtctggcccatactaaatattaaggacaattgtttaaagacatggattgtcataaaatagtataacacttgttagatctctaagccaacaaaccaactggactcttttttaagaacgtctcaaacacccgggcttctggttctttcatgcgttaccttattttgagcaaggtccttactctgctttttaacttttcctggtgctttacaggaaatgtaaggaggtaacggatgttatggagttgttggcatatttcagaggcttatatgcacattgaaggctctttcatcataaatgttttttctttcttcccccactgttgatagctgcaaaacaattagcatcagccttgaccagctgcacgtactagattttaaaatgtgtgcattttcattttggagaagatgtaatggaccaacattaatcattgtttttttctttacccaacctggcacatagaagtaagaggaagagaatgaacaagaaatatattggttatttttaggttctttataagaaagatggaggaagacagtgggtggggaagaatgggtttgaaaaaggcaggcaaataggaaatgaagttatttttggtgatttttctaaggtagttggataataatctaaataaaggactcttattattttgggtctttgaattcataaaaagtaattttctctgtagatgctaattgagtgtggtaagatgtcttgttgcttgaaagttgtattttcgttgctctacctggagagcatataacagtgcttttatgttgatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagtttacccagtgatgatttaataaaattatgaaaaatcag

SEQ ID NO: 285365 - DNA, 1025 bp, Homo sapiens
ggccggaagtgcgtgggctgccgggctggcccagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagtttacccagtgatgatttaataaaattatgaaaaatcag

SEQ ID NO: 285366 - DNA, 1091 bp, Homo sapiens
ggcttactgagtacccaggaaatgtggcacggctgccgaagataagttaggtagtacatataggactctgtcgtacgaatccttcagggtgccctgcgcagtagaataaggggtaggattggcctctgcgagtcaatcctctgtcagtggcgcgactatcgcatgtcgtcatcgtacatcatatacccatgcaagtgactactcgaatgactaacacctgtgcactccttacctcatgatggtgcttcacagtcagccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagtttacccagtgatgatttaataaaattatgaaaaatcag

SEQ ID NO: 285367 - DNA, 962 bp, Homo sapiens
ggccggaagtgcgtgggctgccgggctggcccagcttagggttttcaggaaatttggaagctgccgcagtagttggagtctaaggactcgtgacaatcttcgggtgcccttcgagagaaaaggggagccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagtttacccagtgatgatttaataaaattatgaaaaatcag

SEQ ID NO: 285368 - DNA, 836 bp, Homo sapiens
atccccgggaatgggtgtaccgtcagtggtgagcactggggtcaggtctaagacgctggagtggctatcagggggggtagtttacgctgtggagagtaattcaccaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagtttacccagtgatgatttaataaaattatgaaaaatcag

SEQ ID NO: 285369 - DNA, 777 bp, Homo sapiens
ggccggaagtgcgtgggctgccgggctggcccagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagaagaaaaaggtggggggaggggactaagatccctatgtcctagagatgggggaatgtgttattgtatgggaggagggagtcaggtagtgacgggactggatgatcgtgttagggatctttgttctctgaaacgcaaccctgtctaggacaatatacacgtgagtgagtgcttaataaatttaatttcaaacatccggactccatg

SEQ ID NO: 285370 - DNA, 1492 bp, Homo sapiens
tctcgaacacctgggctcaagcgatcctcttgcctcggcctctcaaagtgctgagattactttggaagtgcaagaaccaccgcgtctggcccatactaaatattaaggacaattgtttaaagacatggattgtcataaaatagtataacacttgttagatctctaagccaacaaaccaactggactcttttttaagaacgtctcaaacacccgggcttctggttctttcatgcgttaccttattttgagcaaggtccttactctgctttttaacttttcctggtgctttacaggaaatgtaaggaggtaacggatgttatggagttgttggcatatttcagaggcttatatgcacattgaaggctctttcatcataaatgttttttctttcttcccccactgttgatagctgcaaaacaattagcatcagccttgaccagctgcacgtactagattttaaaatgtgtgcattttcattttggagaagatgtaatggaccaacattaatcattgtttttttctttacccaacctggcacatagaagtaagaggaagagaatgaacaagaaatatattggttatttttaggttctttataagaaagatggaggaagacagtgggtggggaagaatgggtttgaaaaaggcaggcaaataggaaatgaagttatttttggtgatttttctaaggtagttggataataatctaaataaaggactcttattattttgggtctttgaattcataaaaagtaattttctctgtagatgctaattgagtgtggtaagatgtcttgttgcttgaaagttgtattttcgttgctctacctggagagcatataacagtgcttttatgttgatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtacttta

SEQ ID NO: 285371 - DNA, 3489 bp, Homo sapiens
ggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgctctgacagcactgtgccctgcccctacagcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaatttggaactcgatcttctcttccttaaatgaaaagttattgaccaaatggactttttaaaagacacaggacccttaactttgccccaaagtgaggggctccacaccaaccccaggcggaggaacactcagacagattaaggatactgttgacctgtcactgtttattatttcagcactaaaactgaggagcctcaactgctggctcttcttccctttgtatttgtgtaaggagcactgcactcccataaaaggttttaaaatacaaaatgtacaagaacacacaattcc

SEQ ID NO: 285372 - DNA, 2328 bp, Homo sapiens
ggcacgaggggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacgtcaattgttttcgaagcccgaggtgataaagcagaaatacgagacggggccttgcagcaaggctgatgtggtggacagtgagactgtggtacgggctcgtgggttgccgtggcagtcatcagaccaggacgtggctcgcttcttcaaagggctcaacgtggccaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagc

SEQ ID NO: 285373 - DNA, 302 bp, Homo sapiens
tctgctctggtcgacttctgctatccattttataaaacacaaggtttcaatttgagcccatctgagccttaaagatccattctgaataccaaaaacagggcttcacagccaggcccagaagaggtctggtgataatggctggccctgggtggggatagtttacacccgggcagcagcaccacacatgaacccaaagacatgttctttttaaagctgttttcagccatgtttctctgtgcatctccagtaagcagaaggtcgacgggtacccgggctccgaaatcggtaatcatgggtcctaa

SEQ ID NO: 285374 - DNA, 4530 bp, Homo sapiens
ggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaatttggaactcgatcttctcttccttaaatgaaaagttattgaccaaatggactttttaaaagacacaggacccttaactttgccccaaagtgaggggctccacaccaaccccaggcggaggaacactcagacagattaaggatactgttgacctgtcactgtttattatttcagcactaaaactgaggagcctcaactgctggctcttcttccctttgtatttgtgtaaggagcactgcactcccataaaaggttttaaaatacaaaatgtacaagaacacacaattccaagtgctgtaaacataactgagaaccagttcctttactaaacatccattttataaaacacaaggtttcaatttgagcccatctgagccttaaagatccattctgaataccaaaaacagggcttcacagccaggcccagaagaggtctggtgataatggctggccctgggtggggatagtttacacccgggcagcagcaccacacatgaacccaaagacatgttctttttaaagctgttttcagccatgtttctctgtgcatctccagtaagcagaaggctacccattccattcctcaacccaagagctagcacagttagagtaggagggggtgcgtactagcacgtgcccagttgctcagtgctgctagtagaaattgatttgcatagtccaatggatgtgtgctttaacaccactatgttgcacaaaaatttaagtctttatctacaaagccaaaaaatattgactcttaacaccaaagcttttacaaagctgatataaaactgcttacatagtatacaaagctctattttaaaatttaatgtttattttaaataggaaagcatttctagtgctacaggcatcaaggtatttagaaggcatcaaaatttggtgcatagcaactctggatcatagaggcttttaattcttgagggcacaaagggtattgcaaggggaactcttgcaataacctcatgtgaggcagctacaccaggggcaaaagggtaggggcaagtctggccatttctctggaatgtcaaccgagaggccaacttcttgcccctccaaaggaagctgtgggcgtccaaccacaggcccagaagcaaatctcactatccacattctgtgacacaactcacttttcaagaaaatttgaaaacacccagctccaagaggggccacagtgatctgctgaagaatagacctttttctctaactaactttaggggagaaatctaaaatatattttgttttttttaaagaccatacttcctcatcctgagtcaacagctcctaacctactgacaacaggtggtgggcaataggccagctccctttcccagacctgaac

SEQ ID NO: 285375 - DNA, 3168 bp, Homo sapiens
ggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagc

SEQ ID NO: 285376 - DNA, 3808 bp, Homo sapiens
ggcacgaggggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacgtcaattgttttcgaagcccgaggtgataaagcagaaatacgagacggggccttgcagcaaggctgatgtggtggacagtgagactgtggtacgggctcgtgggttgccgtggcagtcatcagaccaggacgtggctcgcttcttcaaagggctcaacgtggccaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaatttggaactcgatcttctcttccttaaatgaaaagttattgaccaaatggactttttaaaagacacaggacccttaactttgccccaaagtgaggggctccacaccaaccccaggcggaggaacactcagacagattaaggatactgttgacctgtcactgtttattatttcagcactaaaactgaggagcctcaactgctggctcttcttccctttgtatttgtgtaaggagcactgcactcccataaaaggttttaaaatacaaaatgtacaagaacacacaattccaagtgctgtaaacataactgagaaccagttcctttactaaacatccattttataaaacacaaggtttcaatttgagcccatctgagccttaaagatccattctgaataccaaaaacagggcttcacagccaggcccagaagaggtctggtgataatggctggccctgggtggggatagtttacacccgggcagcagcaccacacatgaacccaaagacatgttctttttaaagctgttttcagccatgtttctctgtgcatctccagtaagcagaaggctacccattccattcctcaacccaagagctagcacagttagagtaggagggggtgcgtactagcacgtgcccagttgctcagtgctgctagtagaaattgatttgcatagtccaatggatgtgtgctttaacaccactatgttgcacaaaaatttaagtctttatctacaaagccaaaaaatattgactcttaacaccaaagcttttacaaagctgatataaaactgcttacatagtatacaaagctctattttaaaatttaatgtttattttaaataggaaagcatttctagtgctacaggcatcaaggtatttagaaggcatcaaaatttggtgcatagcaactctggatcatagaggcttttaattcttgagggcacaaagggtattgcaaggggaactcttgcaataacctcatgtgaggcagctacaccaggggcaaaagggtaggggcaagtctggccatttctctggaatgtcaaccgagaggccaacttcttgcccctccaaaggaagctgtgggcgtccaaccacaggcccagaagcaaatctcactatccacattctgtgacacaactcacttttcaagaaaatttgaaaacacccagctccaagaggggccacagtgatctgctgaagaatagacctttttctctaactaactttaggggagaaatctaaaatatattttgttttttttaaagaccatacttcctcatcctgagtcaacagctcctaacctactgacaacaggtggtgggcaataggccagctccctttcccagacctgaac

SEQ ID NO: 285377 - DNA, 3304 bp, Homo sapiens
ggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccattcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaatttggaactcgatcttctcttccttaaatgaaaagttattgaccaaatggactttttaaaagacacaggacccttaactttgccccaaagtgaggggctccacaccaaccccaggcggaggaacactcagacagattaaggatactgttgacctgtcactgtttattatttcagcactaaaactgaggagcctcaactgctggctcttcttccctttgtatttgtgtaaggagcactgcactcccataaaaggttttaaaatacaaaatgtacaagaacacacaattccaagtgctgtaaacataactgagaaccagttcctttactaaacatccattttataaaacacaaggtttcaatttgagcccatctgagccttaaagatccattctgaataccaaaaacagggcttcacagccaggcccagaagaggtctggtgataatggctggccctgggtggggatagtttacacccgggcagcagcaccacacatgaacccaaagacatgttctttttaaagctgttttcagccatgtttctctgtgcatctccagtaagcagaaggctacccattccattcctcaacccaagagctagcacagttagagtaggagggggtgcgtactagcacgtgcccagttgctcagtgctgctagtagaaattgatttgcatagtccaatggatgtgtgctttaacaccactatgttgcacaaaaatttaagtctttatctacaaagccaaaaaatattgactcttaacaccaaagcttttacaaagctgatataaaactgcttacatagtatacaaagctctattttaaaatttaatgtttattttaaataggaaagcatttctagtgctacaggcatcaaggtatttagaaggcatcaaaatttggtgcatagcaactctggatcatagaggcttttaattcttgagggcacaaagggtattgcaaggggaactcttgcaataacctcatgtgaggcagctacaccaggggcaaaagggtaggggcaagtctggccatttctctggaatgtcaaccgagaggccaacttcttgcccctccaaaggaagctgtgggcgtccaaccacaggcccagaagcaaatctcactatccacattctgtgacacaactcacttttcaagaaaatttgaaaacacccagctccaagaggggccacagtgatctgctgaagaatagacctttttctctaactaactttaggggagaaatctaaaatatattttgttttttttaaagaccatacttcctcatcctgagtcaacagctcctaacctactgacaacaggtggtgggcaataggccagctccctttcccagacctgaac

SEQ ID NO: 285378 - DNA, 2123 bp, Homo sapiens
ggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagcccagttccccacatgtgggtactcataaaccc

SEQ ID NO: 285379 - DNA, 1578 bp, Homo sapiens
ggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtgagcgcccagggctccccacccccagatgtactgttactccagggcggccctctgtgtccctgccctacttggcatgaccagcct

SEQ ID NO: 285380 - DNA, 1253 bp, Homo sapiens
ggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgctctgacagcactgtgccctgcccctacagcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgagagtatgtcgcgactggggtggcggatgtcaagttctacacaggcacagcaatggcgatgactcactgacttcatctc

SEQ ID NO: 285381 - DNA, 907 bp, Homo sapiens
ggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcaggtgagcgccggggtgggtggcggcatggcctggacgtgaggacatttctgggcgggattggcggccggaggctaggcctggcgtgccgcaaccaaccggtccaggcggcaggactgggctcttgtttgaaactttgagcgactctcgcgtgtgcgtgcccctttcatccgcgcgtgccagccattcccctgggctccttacttttcaaccattgcaggaacctactcctaccgaagggatcgggacgcaggctttgggatccatccccagttcccgcccggggagcgaggccgagacgcctttgggagacctgctgggtcaggtctccctgagccgcagccggaagcgaaaggggtcgaggggcccatataggtcacctgtccttgcg

SEQ ID NO: 285382 - DNA, 835 bp, Homo sapiens
ggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtatctgtgacccagcagggttagggtggagaagccactgtgggtacatgtgtctgagtatgtgcatgctgtgggtgggtaatatgg

SEQ ID NO: 285383 - DNA, 626 bp, Homo sapiens
ggggtctggttattggagtcggggcctcaggcagttgtcatttggggggtttattcatcaacatcatgtatctctgggttccattttatcaggttaaaatggagttaaaattcacagtgaacagataagaagacctcttcactgatttgtcagagttacaactcccaagcagctggagagcactaacgataaaaggaccaacccgcaactctggctttctgcctacacatccctgaagatctggcagcttctgtttgcatccttgtcataagacttcctcttccgttcagcaaaccttcctaagaagttacaatctcaaaggtcctacattccttttcactaatgtcatctgtccacagagaagtccacctgtggcaaactgctcttcataggcttgcctagtagagggtgatgggttctgtctttctaggtcaaggaactactttatttttgtcctgtaagcccttttcatcagttaaaaatatttttattaaggaattcatttaaaacataggctgggcacagcagctcatgcctgtcatcccagcactttgagaggtcgaggcaggtggatcacctgaggtcaggagtttgtgaccagtcagttgaccaacctggccaacatg

SEQ ID NO: 285384 - DNA, 681 bp, Homo sapiens
acgtaggaggatgtgatctgtgtcctatctggaatatcaaggggatgaaggcaatggaagtagctaccacttggtgacttagacaaactcttaatgtaaaaccaccatcagagccaccctggagttatggcaaggccaccacagtctcctccaaaggccactgatatggaactgggaacctccctccatagaatgctaaatggctgatgtgaacttggttaaggatctataattcttcttacgaagaaatattcaagcatctatgaagtagacaggatggtatcatgaatgcccccgtgcccctcaccagcttcaacaataatcaacttatgacttcacagctcctctacatccgcgctacttttcctctgctcccacactgctgtttttgtttgttggcttattaacaactttattaagacatatttcacatatcacaaaattgatccatttcaagtatataactcagtgatttctaataactttaccaagtgttgaaaccattgctataagtcaattttaggacatttccatccttccagtaatctcactcatgtccttttacagttaatgcccattcccgtctcccatcacaggcaaacattattaaaaatttaaataaaatagaatttacaattcagttcctcagtttctagccacatttcaattgctccactgggc

SEQ ID NO: 285385 - DNA, 352 bp, Homo sapiens
acgtaggaggatgtgatctgtgtcctatctggaatatcaaggggatgaaggcaatggaagtagctaccacttggtgacttagacaaactcttaatgtaaaaccaccatcagagccaccctggagttatggcaaggccaccacagtctcctccaaaggccactgatatggaactgggaacctccctccatagaatgctaaatggctgatgtgaacttggttaaggatctataattcttcttacgaagaggaaagttctggaagaccaaagaaaatatgtcatgaaatcaagccattaagaagttgtgactccaaaaaagtaaaagcgtgagctactgtacacacatgtatgtt

SEQ ID NO: 285386 - DNA, 581 bp, Homo sapiens
acgtaggaggatgtgatctgtgtcctatctggaatatcaaggggatgaaggcaatggaagtagctaccacttggtgacttagacaaactcttaatgtaaaaccaccatcagagccaccctggagttatggcaaggccaccacagtctcctccaaaggccactgatatggaactgggaacctccctccatagaatgctaaatggctgatgtgaacttggttaaggatctataattcttcttacgaaggttaaaatggagttaaaattcacagtgaacagataagaagacctcttcactgatttgtcagagttacaactcccaagcagctggagagcactaacgataaaaggaccaacccgcaactctggctttctgcctacacatccctgaagatctggcagcttctgtttgcatccttgtcataagacttcctcttccgttcagcaaaccttcctaagaagttacaatctcaaagaggaaagttctggaagaccaaagaaaatatgtcatgaaatcaagccattaagaagttgtgactccaaaaaagtaaaagcgtgagctactgtacacacatgtatgtt

SEQ ID NO: 285387 - DNA, 557 bp, Homo sapiens
tgtcttatttcaagcagaagttgccgccctaacttccaaatttggggactgaacatcgttcaccgaatacactttgtgatgttttaggtgatgaagtacctgctgccagagtttcccctgaaacacacaaagaagagtcttttacttgtgattcagttgtttcaggagttcttgactggccaatgtgcaaggattcatgtaagctgcttttcacttcttcttctggtcgttgtgattttgctggaggttttgataccactggactcttctgaatggtctggacatcagttggcgagagaaaggcactgaagaaattttcagattcatcgaccacagtcctccgaactggctttgtgattgctttaggagaggctattggtggactctgaggttcagtgtttgatttcaacccccaggttgaagtatcccatcctccactgacaggggaacttattcctttaacaaaaaagtaaatattaaaaaagaacacatatatgttacattaatatttcaatcatcattataaatcagtataaatataaatttagaaaaaatac

SEQ ID NO: 285388 - DNA, 760 bp, Homo sapiens
cgaggaggaggcggaggagacggcggctgttccagaggagggagtcgtcataaccggctactgccgctcaccggaaacctcgggcgcgggagctgggccagggggcgccaaggagcagctgggacaccttggccagccggcgccgtgggcgggctcgggccccgcagaggcaggaccgggactacacccaggagggccagggcgcggggcccgacgctcggagcggcttcagcccggcgagcggcctcgacccggcgagcgcagcagggaggggctcagagtcgaggaaccatctgcccttcctggcgttctcccgcgaacgttcgcgcgagtccgccagctccctcaccagggccggaaagaccgacggcacgtgccggcgccggacgcccatctccatcgcagcagcccgcgcctccttgagcgagagcgttaaagcgctcagaggatgttaggacggggtgggtagaaaacctgactcttcgtgtcttctgcgttgcactgaggtggatttttacttttgtcttatttcaagcagaagttgccgccctaacttccaaatttggggactgaacatcgttcaccgaatacactttgtgatggtgaggatactttggagtccacacacattttaaaagcagtatagttttacctatccgtaaactcatcaagttcaaatgctactctgtggagtttaatttttatggttttgttaatttactttattactgcttataattatttgaactcccatccccca

SEQ ID NO: 285389 - DNA, 781 bp, Homo sapiens
  misc_feature (161)..(161): n is a, c, g, or t
  misc_feature (239)..(239): n is a, c, g, or t
  misc_feature (268)..(268): n is a, c, g, or t
cttccaggcctcaaggtatagcgcgcgccctgcgggcgtgaaggtaactttatgacccgttatcctggttcggggttcggacagctgagtttgagaatggttgtataggccttccacgggacctcgatttcaggaccttgaattactcccaggacttcgtngtcttttggggactgcaaagctttagtgtttattttactagccatcccaggaggcaagtaggaaataactagttcagnttttttaacaacgaacttgattttatcanacactgcagcttccccaaccccgcgcacagcgggcactggtttcgggcctctctgtctcctacgaagtccccagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggagatggtttccccagacccccaaattatcgtggtggcccccgagaccgaactcgcgtctatgcaagtccaacgcactgaggacggggtaaccattatccagatatttggggtgggccgcaaaggcgagc

SEQ ID NO: 285390 - DNA, 887 bp, Homo sapiens
tacttcataaactttaagatagttatgttttattcctggggaatacccctgagtgccaccctgcgattcgcgctcgagtagctgtgagaaaagccgcttcgtgtcgggggtcgactgttccctgctggccagctgtgggtgtggagccagtgactttgcctcttcacatcttggtgactccgtggctgtgtggacacaggattgcaggggcaggagtggaagcaagaagcctcctaaggagatggatgctggagctgtggtgagagggaaggggggccagggctgagaaggggtggagagaggtgggttgactaggacacatggcagagccggtgcgctggctgtatggagtgaggactaatggggaatcaaggacgtccagctgtggatggcagaagggccactgtctgaagtgggaagtctggacattcccaaaggagtctttgaaagactgggtcttctcctgagcctgagagcagtgcttcttccaatggcactgcttccattttaagcatcagcatggcccgggagcttgttggaatgaagaatctccagctccacccgaaacctgctgaatcagaaccagcatttaacacgtcaccaggatcccaggtcacttggctgtccttggctcaactgtgagtaaggaggagtcctgcggaatgaaaaatgactacccagatttgccaccaaaatccagcaggagtgccttagaaagcagggtaacatactcacaggatctgtggatcaggacgtgaacatctctggaagccattatctaccccacaccatctctctagcacttagtacacggcctgtacagagcagatgctcggcaaggatctggagaaagaaagaatgaatgaataaataaacaaagaaatcag

SEQ ID NO: 285391 - DNA, 421 bp, Homo sapiens
gtggtaggatcaagacactgttttctgttccagctcattttgcgaacaatgttatgtcacaggtcacttggctgtccttggctcaactgtgagtaaggaggagtcctgcggaatgaaaaatgactacccagatttgccaccaaaatccagcaggagtgccttagaaagcagagacgagaggacacagacacacagagacagcatgtgaagacaggcaagattgtgtgatgctgccacgagcccagggatgctgggaaccagaagctggaagagacaaggaaggattctccctctcagggttattgtggtgaccacagaatgcatttggaagtggctttgtaaactgcagagtgataagccaattcaatatttggagttgtgttttatcttccaaaggcctcagtaaacatttgtagaactg

SEQ ID NO: 285392 - DNA, 1754 bp, Homo sapiens
ttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttgggctggagtacaatggcgtgatcttggctcacttcaatctccagctcccgagttcaagcgattctcctgcctcagactcctgagtagctgggattacaggcgcctgccaccatgcccagctaatttttgtaatatttagtagagacggggtttcaccatgttggccaggctggtttcgaactcctgacctcaggtgatccacccgcctcagcctcccaaagtggtgggattacaggcgtgagccaccacacccagcctattctttttaagtttcttgatgtagtggcagtagtcttgtgctcttcaggagagtgtcccgagttctacgtcccacatcaactgagggtgtgaacttgtggaggacttttgtctgaatctctttttcaatctctatacaatgtggcggagttgtgccacctacatgagccaatggagaagaaagctcctggtatactttaagtactcaacaatattaaatactgaatatttgtcaattgacgaa

SEQ ID NO: 285393 - DNA, 706 bp, Homo sapiens
cggccgctgcaaatgaccaattcttaagatatgtgaaaaaccattcagttgtagcaaacatcatacaccagagactttgtttgacatcagataaatcacacgggttagagaactttttggtttttagaggtcaaggaatcattcatcatgagcttccatattttgcacatatttctgaaaaatattcctgaagtggaaaagttttgttatacaacacatagttcctggtacatgagggaacccacgaaaaaaggtatcagtaaacagtgttacagaacttccaatttaatatatatatgttttagtcaaacagaattcaaacccaaggacagtttaggtggtggtcagacccagtgaaggtgctgggagtggtatacttactcacttacctcttaaacatgcaatgaaaatattctacagccaaacccttatcataaactccagccctggtcattcagcttctaaatgcagtaggaaatgtcaagagatggtggatgttaacaagttattgagtactgtcccatgttgggagacagttctgtcaagatgttgacctttttctggagtactacagagcgtgcattcctgaaaacctctaggggttagggacaggttgtgaatttgtcaattgtgaatacgcacatggtggcactataaaaagaattgaaagtaaatcccctatccctaacatcaggtcatgctctgc

SEQ ID NO: 285394 - DNA, 811 bp, Homo sapiens
ttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccccttgaaaaattgttaaagaaagcttgttggctttttgttggaaagaattt

SEQ ID NO: 285395 - DNA, 3499 bp, Homo sapiens
  misc_feature (2435)..(2435): n is a, c, g, or t
ttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttggaggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttggaaataacagatgaagataagaaaaaatccacaaaagacagatatgacaaatataaggaagttggggaacatccacctctgtcttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatgagtgtgggaagaccttcaggcaaacctcccagctcattgttcatctcagaacccacacaggggaaaaaccctatgaatgcagtgagtgtggaaaggcctataggcacagctcccatctcattcaacaccagagactccataatggggagaaaccctataaatgtaatgaatgtgcaaaagcctttactcagagttcccgactcattgaccaccagagaacccatactggggagaaaccttatgaatgcaatgagtgtggagaggcattcattcgaagcaaaagtcttgctcgacatcaggtcctgcacactggtaagaaaccttacaaatgcaatgagtgtgggagagcattctgttccaatagaaatctcattgaccatcagagaatccacactggggagaagccttatgagtgtagtgaatgtggcaaagccttcagtcggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatntaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaagtcctcaggtctggcttggtcagtttcttaaggtatggttctctgagacagagagcaacgacctttgagttaagctgtctttataagcaggatgctcatagtggtttcccggagccagtagtcacggtggaccattccctacttgctttttccttggatcactaaggtgggagagtaggagtaacttattccagttcttacccattattaggaaggtaaggactacacatgtcattgaattgtaggtttcctttttttttctttacttttaaattttaacttttaaaatctatttcatttcttagttatgcatctcataatcagactccatgctttttaaagacagagataatatcttctctattctattctacttcctccatttcaccatttatacaaagtcattcaaaaaggctgattcatgccttcctgcctcttggctatggccctccccatctactctttaaactttaatctataacttttcatcagttttgttccctatctagaaaacattttcttctgtttgctaatctttgtccctcacaatttttgaaatccatctcatcactgaaatactttcttcttcaagtacttttttatttttcttcaacttctcttgatttgacctcagtgctttgaattcactggtgctacaatatgtaactgtggttaattgccttgtaaattttgcgtgtctgtatacttttataccaacttattgtaggctctttgaggtcaggtatgtatttctttcccatatagatagtattttgtacataccagttgttaaataaataatttttaaaatcaaaaaactcaca

SEQ ID NO: 285396 - DNA, 3462 bp, Homo sapiens
  misc_feature (2398)..(2398): n is a, c, g, or t
ttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttggaggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttggaaataacagatgaagataagaaaaaatccacaaaagacagatatgacaaatataaggaagttggggaacatccacctctgtcttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatgagtgtgggaagaccttcaggcaaacctcccagctcattgttcatctcagaacccacacaggggaaaaaccctatgaatgcagtgagtgtggaaaggcctataggcacagctcccatctcattcaacaccagagactccataatggggagaaaccctataaatgtaatgaatgtgcaaaagcctttactcagagttcccgactcattgaccaccagagaacccatactggggagaaaccttatgaatgcaatgagtgtggagaggcattcattcgaagcaaaagtcttgctcgacatcaggtcctgcacactggtaagaaaccttacaaatgcaatgagtgtgggagagcattctgttccaatagaaatctcattgaccatcagagaatccacactggggagaagccttatgagtgtagtgaatgtggcaaagccttcagtcggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatntaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaagtcctcaggtctggcttggtcagtttcttaaggtatggttctctgagacagagagcaacgacctttgagttaagctgtctttataagcaggatgctcatagtggtttcccggagccagtagtcacggtggaccattccctacttgctttttccttggatcactaaggtgggagagtaggagtaacttattccagttcttacccattattaggaaggtaaggactacacatgtcattgaattgtaggtttcctttttttttctttacttttaaattttaacttttaaaatctatttcatttcttagttatgcatctcataatcagactccatgctttttaaagacagagataatatcttctctattctattctacttcctccatttcaccatttatacaaagtcattcaaaaaggctgattcatgccttcctgcctcttggctatggccctccccatctactctttaaactttaatctataacttttcatcagttttgttccctatctagaaaacattttcttctgtttgctaatctttgtccctcacaatttttgaaatccatctcatcactgaaatactttcttcttcaagtacttttttatttttcttcaacttctcttgatttgacctcagtgctttgaattcactggtgctacaatatgtaactgtggttaattgccttgtaaattttgcgtgtctgtatacttttataccaacttattgtaggctctttgaggtcaggtatgtatttctttcccatatagatagtattttgtacataccagttgttaaataaataatttttaaaatcaaaaaactcaca

SEQ ID NO: 285397 - DNA, 3370 bp, Homo sapiens
  misc_feature (2306)..(2306): n is a, c, g, or t
ttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcggatactgtggcatatgaggacctatctgtagactacactcagaagaaatggaaaagtctcacactcagtcagagagccctgcagtggaacatgatgccagaaaatcaccatagcatggcctccttggaggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttggaaataacagatgaagataagaaaaaatccacaaaagacagatatgacaaatataaggaagttggggaacatccacctctgtcttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatgagtgtgggaagaccttcaggcaaacctcccagctcattgttcatctcagaacccacacaggggaaaaaccctatgaatgcagtgagtgtggaaaggcctataggcacagctcccatctcattcaacaccagagactccataatggggagaaaccctataaatgtaatgaatgtgcaaaagcctttactcagagttcccgactcattgaccaccagagaacccatactggggagaaaccttatgaatgcaatgagtgtggagaggcattcattcgaagcaaaagtcttgctcgacatcaggtcctgcacactggtaagaaaccttacaaatgcaatgagtgtgggagagcattctgttccaatagaaatctcattgaccatcagagaatccacactggggagaagccttatgagtgtagtgaatgtggcaaagccttcagtcggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatntaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaagtcctcaggtctggcttggtcagtttcttaaggtatggttctctgagacagagagcaacgacctttgagttaagctgtctttataagcaggatgctcatagtggtttcccggagccagtagtcacggtggaccattccctacttgctttttccttggatcactaaggtgggagagtaggagtaacttattccagttcttacccattattaggaaggtaaggactacacatgtcattgaattgtaggtttcctttttttttctttacttttaaattttaacttttaaaatctatttcatttcttagttatgcatctcataatcagactccatgctttttaaagacagagataatatcttctctattctattctacttcctccatttcaccatttatacaaagtcattcaaaaaggctgattcatgccttcctgcctcttggctatggccctccccatctactctttaaactttaatctataacttttcatcagttttgttccctatctagaaaacattttcttctgtttgctaatctttgtccctcacaatttttgaaatccatctcatcactgaaatactttcttcttcaagtacttttttatttttcttcaacttctcttgatttgacctcagtgctttgaattcactggtgctacaatatgtaactgtggttaattgccttgtaaattttgcgtgtctgtatacttttataccaacttattgtaggctctttgaggtcaggtatgtatttctttcccatatagatagtattttgtacataccagttgttaaataaataatttttaaaatcaaaaaactcaca

SEQ ID NO: 285398 - DNA, 912 bp, Homo sapiens
ttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtgagcagttgagtctagaatggcggcctgatgcttctctaatgctt

SEQ ID NO: 285399 - DNA, 1298 bp, Homo sapiens
ttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttgggtaatgattctgtttcctagtcacttaaagtctgcatgctgcaaa

SEQ ID NO: 285400 - DNA, 618 bp, Homo sapiens
cggccgctgcaaatgaccaattcttaagatatgtgaaaaaccattcagttgtagcaaacatcatacaccagagactttgtttgacatcagataaatcacacgggttagagaactttttggtttttagaggtcaaggaatcattcatcatgagcttccatattttgcacatatttctgaaaaatattcctgaagtggaaaagttttgttatacaacacatagttcctggtacatgagggaacccacgaaaaaaggctggagtacaatggcgtgatcttggctcacttcaatctccagctcccgagttcaagcgattctcccgcctcagcctcccaaagtggtgggattacaggcgtgagccaccacacccagcctattctttttaagtttcttgatgtagtggcagtagtcttgtgctcttcaggagagtgtcccgagttctacgtcccacatcaactgagggtgtgaacttgtggaggacttttgtctgaatctctttttcaatctctatacaatgtggcggagttgtgccacctacatgagccaatggagaagaaagctcctggtatactttaagtactcaacaatattaaatactgaatatttgtcaattgacgaa

SEQ ID NO: 285401 - DNA, 299 bp, Homo sapiens
actggtgagtaaggctgcggctatagcagccacaaccgtcagtaatgaacactccctcacacggagcacttcctcacccggagcactccctaacacagagcacttcctaacagaacacttcatcacacggagcacttcctctaacacggagcacttcctctaacacaggacacttcctcacacggaacacttcctcacacggagcacttcctgtaacaggacacttcctcacacggagcacttcctctaacatggagcacttcctgtaacacaggacacttcctcacacggagcacttc

SEQ ID NO: 285402 - DNA, 1444 bp, Homo sapiens
ccggggcaccggcggtgggcggggccagcagcgcaaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagaggcctcggctggtggctgggccgcagtttctggccttcctggagccacactgttccatcaccaccgagactttctacccaacgctgtggtgttttgaggggcgactacaaagcatcttccaagtcctcctgcagtctcagcccctagtcctttatcagagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgaaacagaaaggtgattgaaaaggtggtggacatagactttgtactacaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcct

SEQ ID NO: 285403 - DNA, 803 bp, Homo sapiens
ccggggcaccggcggtgggcggggccagcagcgcaaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagaggcctcggctggtggctgggccgcagtttctggccttcctggagccacactgttccatcaccaccgagactttctacccaacgctgtggtgttttgaggggcgactacaaagcatcttccaagtcctcctgcagtctcagcccctagtcctttatcagagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccagtaaggatgggtgcagccccagagtggggtggcatctgagaacgtgtattagggagaagtcaatccggacactgatagataagaagaatgctacacaaagggagtctttggacaggggtctttctgaatactgaaaggggagaggggctaagaagggtctggctaagatgtacctgtgtgtgcca

SEQ ID NO: 285404 - DNA, 1380 bp, Homo sapiens
ccggggcaccggcggtgggcggggccagcagcgcaaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgaaacagaaaggtgattgaaaaggtggtggacatagactttgtactacaggtataatattcagccatgcccctggttcccccaaatgagtcttccactatcttcctattctttatcatcttagcctatcctatggtaagacctgcaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcct

SEQ ID NO: 285405 - DNA, 1591 bp, Homo sapiens
ccggggcaccggcggtgggcggggccagcagcgcaaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgaaacagaaaggtgattgaaaaggtggtggacatagactttgtactacaggtataatattcagccatgcccctggttcccccaaatgagtcttccactatcttcctattctttatcatcttagcctatcctatggtaagacctgcaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcctaatgggctgaggttcattttcccattcctcaaggtaagggtagactacctaggaacttattgcatctttaggccagctggcttagtgctacccatctgaacccccagattactacccaagtcttccttttgccccttcctgccctaacagcaagtaccaggccagtcccttccccagcaaatgccaggggcttcatgtgaagaggaactgg

SEQ ID NO: 285406 - DNA, 1212 bp, Homo sapiens
ccggggcaccggcggtgggcggggccagcagcgcaaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgcctatcctatggtaagacctgcaggcccgtacaatccgccagtttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcct

SEQ ID NO: 285407 - DNA, 589 bp, Homo sapiens
acctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcaggtgggtgcgggtccaccgctctggccagcgggtttgggtgtagggggcagcttccagacacgggcttgggcccttggtgggaactgggatggttgggcttccccacaggtgaaatttgctaccaccgaatggagagtcggctctgcctctctagtgcctctgcatcccatgtgatccccatgccagctgggccttttgggtaccggagggtgctgctccctataatgtggacaagcatttggggaaaggtggggtggaaggcatcctgaggtatcagagatgtgcacactttgcgttcctttttaggtggtttagctgagtctttcagctgcactgaaggaaggaaccagaggtctgtgggtcatggctaac

SEQ ID NO: 285408 - DNA, 932 bp, Homo sapiens
tcagtttttgctaaatattgtctttctttattcacagatgatagtcaatgggcacaacatataagtagttacaatgaaatgagaagcaatatagcagtcaggctatatgcatgatttaacaacaaaattatcacttccttttaatttagaataagggacaatttaaaaagcatctcttggccctatcatttctgttccagtagttagtgttcatatgtgaatactaagtttgacattcctttctcccatagaaccattttggtgatttggatggtggccactacactgctttctgcaagaattcagtcacccaggcctgatatagctttgataacacacgagtcagtgagattccagatacttctgttcaaaatgctatggatctcctgttctatagctgccagcccttttccataccaatacaaaagcgttaagagccaggaaaatggtgtttcctgaacactgcaaaacaagcagtcagcatctggtggtagagttttgcttggtcattaaactcttagaacttacttgcatcattaacatttttatgccttgtgggcatgttatacaacctttcatcttaagataaatctgtcgtccagaagatgggtcttggttcactaaaaaaggcagtgtgaatataatgcaatgctaatggatgcaggccttcaaaacactgcaattatatagtgagttcaggtttcaaaattcagtgtttatcagaaaatatctcataatcatatatattcaacaaattattttccaaagatactcatgaagctaaacaaaaataatttttgttcaaatggctcgatgagtttaagaatatgatttgaatatatttgatataataatttagccaagaagtggtctcttagactaattgtaaaacatgaaaagttgtcagcttcacaatttgaaccccatccttt

SEQ ID NO: 285409 - DNA, 968 bp, Homo sapiens
ttccttaacaggactgtctccaatgtttttttcaacaagacgcactgacctggaacaacgaaattcactgctccttttgtgaaaccaagcaagaaactgctgtgagggccagtatttccaaagcaccaaaaataattattttccacctaaaaaggtttgacattcagggtacaacaaaaaggaagctgagaacggatattcattacccactcactaacttggacctcactccttatatttgctcaattttccggaaatatcctaaatacaacctctgtgcagtggtgaaccattttggtgatttggatggtggccactacactgctttctgcaagaattcagtcacccaggcctgatatagctttgataacacacgagtcagtgagattccagatacttctgttcaaaatgctatggatctcctgttctatagctgccagcccttttccataccaatacaaaagcgttaagagccaggaaaatggtgtttcctgaacactgcaaaacaagcagtcagcatctggtggtagagttttgcttggtcattaaactcttagaacttacttgcatcattaacatttttatgccttgtgggcatgttatacaacctttcatcttaagataaatctgtcgtccagaagatgggtcttggttcactaaaaaaggcagtgtgaatataatgcaatgctaatggatgcaggccttcaaaacactgcaattatatagtgagttcaggtttcaaaattcagtgtttatcagaaaatatctcataatcatatatattcaacaaattattttccaaagatactcatgaagctaaacaaaaataatttttgttcaaatggctcgatgagtttaagaatatgatttgaatatatttgatataataatttagccaagaagtggtctcttagactaattgtaaaacatgaaaagttgtcagcttcacaatttgaaccccatccttt

SEQ ID NO: 285410 - DNA, 955 bp, Homo sapiens
ttccttaacaggactgtctccaatgtttttttcaacaagacgcactgacctggaacaacgaaattcactgctccttttgtgaaaccaagcaagaaactgctgtgagggccagtatttccaaagcaccaaaaataattattttccacctaaaaagaagcatgaggagatttgtctctaatatttaccgtgcgagtgtggttgggctcctggaaggaaaattcacaaagtgtggtccccctgtgactggattctttggagtttttaactctcagactctgcactgagcctctagcaattcatcaattacagttcaggttttcctacgcagacctgttccctcagaggtttctgctcggcagttttggctctggtttgacattcagggtacaacaaaaaggaagctgagaacggatattcattacccactcactaacttggacctcactccttatatttgctcaattttccggaaatatcctaaatacaacctctgtgcagtggtgtttcgctcttgtctcgaactcatgacctcaggtgatccacctccctcatcctcccaaagtgctgggattacaggtgtgagctaccgcgccaagcatactttttcattaaatattttaaagatatatccatattgttgcatgtggttataatttcactagcctatgatgtatattgtgtgaatatatcataaattatccattttcctattgatatttcattgtttccaaatttttgctggcatgaacaacattatgcagacattcctgcatatatatgtgcataagagtttctctcatgtatatacttaggagtgaggtcacttagatcataaagtatgtgcatatttaactttctacaagtgattataccaatacatacccctaccaggatcatcagacttcttaatttttgccatctaatggatacaaaattatctcattttagtttttcc

SEQ ID NO: 285411 - DNA, 878 bp, Homo sapiens
tcagtttttgctaaatattgtctttctttattcacagatgatagtcaatgggcacaacatataagtagttacaatgaaatgagaagcaatatagcagtcaggctatatgcatgatttaacaacaaaattatcacttccttttaatttagaataagggacaatttaaaaagcatctcttggccctatcatttctgttccagtagttagtgttcatatgtgaatactaagtttgacattcctttctcccatagaaccattttggtgatttggatggtggccactacactgctttctgcaagaattcagtcacccaggcctgatatagctttgataacacacgagtcagtgagattccagccataccaatacaaaagcgttaagagccaggaaaatggtgtttcctgaacactgcaaaacaagcagtcagcatctggtggtagagttttgcttggtcattaaactcttagaacttacttgcatcattaacatttttatgccttgtgggcatgttatacaacctttcatcttaagataaatctgtcgtccagaagatgggtcttggttcactaaaaaaggcagtgtgaatataatgcaatgctaatggatgcaggccttcaaaacactgcaattatatagtgagttcaggtttcaaaattcagtgtttatcagaaaatatctcataatcatatatattcaacaaattattttccaaagatactcatgaagctaaacaaaaataatttttgttcaaatggctcgatgagtttaagaatatgatttgaatatatttgatataataatttagccaagaagtggtctcttagactaattgtaaaacatgaaaagttgtcagcttcacaatttgaaccccatccttt

SEQ ID NO: 285412 - DNA, 408 bp, Homo sapiens
ttatacttacactttaaatatgtgcagtttattattagttataacacaatgaggttgtcagaaaaagagaaatacttttaaaaatatttaaaattaattgacccaagtatcaattaattttattactcacttccggccagtgtgcctcgtcaatctaaccatcagcttgcgtgcctcttctgagctagattgagtgtttttaacaaatgaaattggtttctcgagtccatgtttttccaaaagctctgacacactataagtgaaaaaagaattatttaatgtcttgctaccaaacaaaaagagtctaagaatcttaggcatagaggtagcccttcagtgtttagtattaaaaaaaaattatcccatagtgtaatccaattttacatataacgttgattctcagcaaaa

SEQ ID NO: 285413 - DNA, 472 bp, Homo sapiens
attttttatttattttattttattttgcttataaacattcaactaaacaaatgacctgtaatggaattgatgaatgacttatgagcatatgctggtttggccagacagtatacacaaacttatatactacagaatgttattacacttgtgaaattctcttgtctaacctgaatttacattccatggtgataacatggtatatgtattgttattaaagtaagtgactatgtcaaaaaaaaaaagaaagaaatatccgtgtagtgttcaggcaacaatagggagcccccttgcccgtgtggagctggttctcatgcagccccactgctagcctggcccgggcctgctctcttccatccacaccccaagatccgcagggccaagctctccccctgggcacccagcatcgttcaggcccccaaggccccacttggtgtccctgaccctgggctctgggtggcccctcacctcggga

SEQ ID NO: 285414 - DNA, 1248 bp, Homo sapiens
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctaaaaaa

SEQ ID NO: 285415 - DNA, 1214 bp, Homo sapiens
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgaatattaacatggagggcattgcatgaggtctgccagaaggccctgcgttgtggatggtgacacataggatggctctatgctggtgacgggacacatcgcctctggttaaatcaccaa

SEQ ID NO: 285416 - DNA, 810 bp, Homo sapiens
  misc_feature (784)..(784): n is a, c, g, or t
  misc_feature (797)..(797): n is a, c, g, or t
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggaagntgtggtcctggcnagagcctctgagc

SEQ ID NO: 285417 - DNA, 515 bp, Homo sapiens
tctcaatgtgagtttctatcccagctagtcaagggttctctatgttactctgcatgactcccctttaaacgtcagtctttgttctgcaatgccatcttgtcacagggtcatctactgcttatttgtggcactgttttgtcttctgtttatgtttatttcacagcttgtcagagtctatacaactcagcagaaagaacacggcttgcctgctccctctcttgaagattgattgcaatgggagtggtttctctgtttctttgtatagtcgaacagatatttacttcttccaagaagatacaattcagaggaatttttatggcaaaagttagtggagacggggtggatgaaatctgttgggagagtatcactgttctgatgggcggccttgagcaccacactgtaatactagacctggcctaaagagaatttctcatgtactattctcacctctgggaaaattacctgaaacgataaaatatcctcattttaagaaaaaaaaaatactagaacctaac

SEQ ID NO: 285418 - DNA, 1165 bp, Homo sapiens
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcagttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctaaaaaa

SEQ ID NO: 285419 - DNA, 1195 bp, Homo sapiens
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctaaaaaa

SEQ ID NO: 285420 - DNA, 1152 bp, Homo sapiens
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctaaaaaa

SEQ ID NO: 285421 - DNA, 927 bp, Homo sapiens
  misc_feature (920)..(921): n is a, c, g, or t
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacattccacctgcagacgagcaagatggaaaagcatcagataatccaaaagttacactaatattaaaatcaccaaaaaaatagaaatgctatttctgagcacaagcaactccatgaaccctatcctggtttctcaataactccgaccactagaaggagacacggccaatttcagagctgggatgaggaaccttcaactgggaaaaacaagttaactgatatcaaatacaacaatataaaaacaattgaattctggttaaaaaaagaagagctacaaaagatattttgattaagcaatgaaaaattaaaatatggaccggatannaaaaaa

SEQ ID NO: 285422 - DNA, 1684 bp, Homo sapiens
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagtgaggaaaaagaaatgacaggcatacaaaagagagaagtggaggagaagaattgggggtaaggaggactgggatttatttccttgccttttcactaatctctccagtttcccaaggaggaaacagaaatacttactcttgcaatcactatcttcttccccaattttctgttttattttttcccttttaagaaccacggctagctagttttattgtcatatctagacagttgttactttcacagttctgtgtcacatttatcttgatcttccacacctcacaattcctttttcccagggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctaaaaaa

SEQ ID NO: 285423 - DNA, 1467 bp, Homo sapiens
  misc_feature (1460)..(1461): n is a, c, g, or t
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagtgaggaaaaagaaatgacaggcatacaaaagagagaagtggaggagaagaattgggggtaaggaggactgggatttatttccttgccttttcactaatctctccagtttcccaaggaggaaacagaaatacttactcttgcaatcactatcttcttccccaattttctgttttattttttcccttttaagaaccacggctagctagttttattgtcatatctagacagttgttactttcacagttctgtgtcacatttatcttgatcttccacacctcacaattcctttttcccagggccgtggagaagtgtaaagatgcaggattggccaagtccatcggggtgtccaacttcaaccgcaggcagctggagatgatcctcaacaagccagggctcaagtacattccacctgcagacgagcaagatggaaaagcatcagataatccaaaagttacactaatattaaaatcaccaaagtaaaagaagctgaataatgtagagcattaaatttgaactgagaatattattgtcaaaaatgatctttttcataaaaataaattttatgcccctctctcctaagaaaatagaaatgctatttctgagcacaagcaactccatgaaccctatcctggtttctcaataactccgaccactagaaggagacacggccaatttcagagctgggatgaggaaccttcaactgggaaaaacaagttaactgatatcaaatacaacaatataaaaacaattgaattctggttaaaaaaagaagagctacaaaagatattttgattaagcaatgaaaaattaaaatatggaccggatannaaaaaa

SEQ ID NO: 285424 - DNA, 1198 bp, Homo sapiens
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctaaaaaa

SEQ ID NO: 285425 - DNA, 597 bp, Homo sapiens
gtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggagccgtggagaagtataaagcgttgagagtacaacctgccggtggagtacaaccctgccggtggggtacaacctgccgctggagtacaacctaccggggatcctc

SEQ ID NO: 285426 - DNA, 1496 bp, Homo sapiens
tgaatactatttatttatacatgtaatagttgtaagagattagagggagcctgtcacctgaagacattccttataccttcatatgtagtacactctgtacataccactctctggagcactgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacgtgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagtgaggaaaaagaaatgacaggcatacaaaagagagaagtggaggagaagaattgggggtaaggaggactgggatttatttccttgccttttcactaatctctccagtttcccaaggaggaaacagaaatacttactcttgcaatcactatcttcttccccaattttctgttttattttttcccttttaagaaccacggctagctagttttattgtcatatctagacagttgttactttcacagttctgtgtcacatttatcttgatcttccacacctcacaattcctttttcccagggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctaaaaaa

SEQ ID NO: 285427 - DNA, 455 bp, Homo sapiens
gctagtgacagaaatggattcgaaatatcagtgtgtgaagctgaatgatggtcacttcatgcctgtcctgggatttggcacctatgcgcctgcagaggtaacaataatatttttagtgttgagagttcaaaggagctagagtaagtggaagctgaccaggttgtcaggcttgtgttctctatgttactctgcatgactcccctttaaacgtcagtctttgttctgcaatgccatcttgtcacagggtcatctactgcttatttgtggcactgttttgtcttctgtttatgtttatttcacagcttgtcagagtctatacaactcagcagaaagaacacggcttgcctgctccctctcttgaagattgattgcaatgggagtggtttctctgtttctttgtatagtcgaacagatatttacttcttccaagaagatacaattcagaggaattttta

SEQ ID NO: 285428 - DNA, 1446 bp, Homo sapiens
agcggggggtgaggagccggcgtgcggcgcggcgggacgggacgtgcggcccagcgagttggtcggtcccggggtcacccgctacgggaagcaggcctcgccacagactaagaaaaatggctttgtcagcccaacagatacccagatggtttaactcagttaagttgaggagcctcattaatgctgcacaactcacaaaacgttttactagaccagcaagaacactgttacatggcttttctgctcagcctcagatatcctctgacaattgctttctccagtggggatttaagacttacaggacttcctccttatggaatagttcccagtctactagctcaagtagtcaggagaataattctgcccaaagcagtctgcttccttccatgaatgaacagtcacagaagacacaaaatatatccagctttgattctgagctgtttctagaagaactggatgaattgcctccattgtctccaatgcagccaatttcagaggaagaggctattcagattattgcagaccctccattgccaccagcttcattcacacttcgagactatgtggatcattctgagactctgcagaagttggttcttctaggcgtggatttgtccaagatagaaaaacatccagaagcagcaaacctccttctgagactggattttgaaaaagacattaagcaaatgcttctgtttcttaaagatgtgggtatagaggataaccaactgggagcattcctgacaaaaaatcatgcaattttctctgaagaccttgaaaatctgaagaccagggtggcttatctgcattcaaaaaatttcagtaaagcagatgttgcacagatggtcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtttatcgtcttgaacttggttttaaacataacgaaattcaacatatgatcaccagaatcccaaagatgttaactgcaaataaaatgaaacttaccgagacgtttgattttgtgcacaatgtgatgagcattccccaccacatcattgtcaagttcccacaggtatttaatacaaggctgtttaaggtcaaagaaagacacttgtttcttacctatttaggaagagcacagtatgatccagcaaaacctaactacatctctttggacaaactagtatctattcctgatgaaatattttgtgaagagattgccaaagcatcagtacaggactttgaaaaattcttaaaaacgctttagatttttatgtatgttaaaatgcagtattgtaaagtgaatatatatatgaataaatgaatatatttttaaatgcctc

SEQ ID NO: 285429 - DNA, 1157 bp, Homo sapiens
cttacctcttaaaaggtgaaaaattagggacttggatgtttaattctaaaatgatcccaagatttaaccactgaaagaagcaaacaagggaagagctggtctttgcagaaatagttttaagtgtgcatattagagcactaatttgtttctctctttcaaagaactggatgaattgcctccattgtctccaatgcagccaatttcagaggaagaggctattcagattattgcagaccctccattgccaccagcttcattcacacttcgagactatgtggatcattctgagactctgcagaagttggttcttctaggcgtggatttgtccaagatagaaaaacatccagaagcagcaaacctccttctgagactggattttgaaaaagacattaagcaaatgcttctgtttcttaaagatgtgggtatagaggataaccaactgggagcattcctgacaaaaaatcatgcaattttctctgaagaccttgaaaatctgaagaccagggtggcttatctgcattcaaaaaatttcagtaaagcagatgttgcacagatggtcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtttatcgtcttgaacttggttttaaacataacgaaattcaacatatgatcaccagaatcccaaagatgttaactgcaaataaaatgaaacttaccgagacgtttgattttgtgcacaatgtgatgagcattccccaccacatcattgtcaagttcccacaggtatttaatacaaggctgtttaaggtcaaagaaagacacttgtttcttacctatttaggaagagcacagtatgatccagcaaaacctaactacatctctttggacaaactagtatctattcctgatgaaatattttgtgaagagattgccaaagcatcagtacaggactttgaaaaattcttaaaaacgctttagatttttatgtatgttaaaatgcagtattgtaaagtgaatatatatatgaataaatgaatatatttttaaatgcctc

SEQ ID NO: 285430 - DNA, 1284 bp, Homo sapiens
agcggggggtgaggagccggcgtgcggcgcggcgggacgggacgtgcggcccagcgagttggtcggtcccggggtcacccgctacgggaagcaggcctcgccacagactaagaaaaatggctttgtcagcccaacagatacccagatggtttaactcagttaagttgaggagcctcattaatgctgcacaactcacaaaacgttttactagaccagcaagaacactgttacatggcttttctgctcagcctcagatatcctctgacaattgctttctccagtggggatttaagacttacaggacttcctccttatggaatagttcccagtctactagctcaagtagtcaggagaataattctgcccaaagcagtctgcttccttccatgaatgaacagtcacagaagacacaaaatatatccagctttgattctgagctgtttctagaagaactggatgaattgcctccattgtctccaatgcagccaatttcagaggaagaggctattcagattattgcagaccctccattgccaccagcttcattcacacttcgagactatgtggatcattctgagactctgcagaagttggttcttctaggcgtggatttgtccaagatagaaaaacatccagaagcagcaaacctccttctgagactggattttgaaaaagacattaagcaaatgcttctgtttcttaaagatgtgggtatagaggataaccaactgggagcattcctgacaaaaaatcatgcaattttctctgaagaccttgaaaatctgaagaccagggtggcttatctgcattcaaaaaatttcagtaaagcagatgttgcacagatggtcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtatttaatacaaggctgtttaaggtcaaagaaagacacttgtttcttacctatttaggaagagcacagtatgatccagcaaaacctaactacatctctttggacaaactagtatctattcctgatgaaatattttgtgaagagattgccaaagcatcagtacaggactttgaaaaattcttaaaaacgctttagatttttatgtatgttaaaatgcagtattgtaaagtgaatatatatatgaataaatgaatatatttttaaatgcctc

SEQ ID NO: 285431 - DNA, 400 bp, Homo sapiens
atcctacttactgaacacatggtcagtacttggtattggttaacctattaaaatttttgccaagtaaactttttaatatttcatcctcccgtgtgcagtgttttttaaaaacttttttttcttttctaggtatttaatacaaggctgtttaaggtcaaagaaagacacttgtttcttacctatttaggaagagcacagtatgatccagcaaaacctaactacatctctttggacaaactagtatctattcctgatgaaatattttgtgaagagattgccaaagcatcagtacaggactttgaaaaattcttaaaaacgctttagatttttatgtatgttaaaatgcagtattgtaaagtgaatatatatatgaataaatgaatatatttttaaatgcctc

SEQ ID NO: 285432 - DNA, 15338 bp, Homo sapiens
agcggcgccggctgagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggagagctccctcctagaaaagatgatagtgtcgaaccaagtggaacaaagaaagaagatctgaatgacaaagagaaaaaagatgaagaagaaactcctgcacctatatatagggccaagtcaattctggacagctgggtatggggcaagcaaccagatgtgaatgaactgaaggagtgtctttctgtgctggttaaagagcagcaggccctggccgtccagtcagccaccaccaccctctcagccctgcgactcaagcagaggctggtgatcttggagcgctatttcattgccttgaatagaaccgtttttcaggagaatgtcaaagttaagtggaaaagcagcggtatttctctgcctcctgtggacaaaaaaagttcccggcctgcgggcaaaggtgtggaggggctcgccagagtgggatcccgagcggcgctgtcttttgcctttgccttcctgcgcagggcctggcgatcaggcgaggatgcggacctctgcagtgagctgttgcaggagtccctggacgccctgcgagcacttcccgaggcctcgctctttgacgagagcaccgtgtcctctgtgtggctggaggtggtggagagagcgaccaggttcctcaggtccgtcgtgacgggggatgttcacggaacgccagccaccaaagggccaggaagcatccccctgcaggaccagcacttggccctggccatcctgctggagctggctgtgcagagaggcacgctgagccaaatgttgtctgccatcctgttgttgcttcagctgtgggacagcggggcacaggagactgacaatgagcgttccgcccagggcaccagcgccccacttttgcccttgctgcaaaggttccagagcatcatttgcaggaaggatgcaccccactccgagggcgacatgcaccttttgtctggccctctgagccccaatgagagtttcctgaggtacctcacccttccacaagacaacgagcttgccattgatctgcgacaaacggcggttgttgtcatggcccatttagaccgtctggctacgccctgtatgcctccgctgtgtagctctccgacatctcataagggatcattgcaagaggtcataggttgggggttaataggatggaaatactatgccaatgtgattggtccaatccagtgcgaaggcctggccaacctgggagtcacacagattgcctgtgcagagaagcgtttcctgattctgtcacgcaatggccgcgtgtacacacaggcctataatagtgacacgctggccccacagctggtccaaggccttgcctccagaaacattgtaaaaattgctgcccattctgatggtcaccactacctagccttggctgctactggagaggtgtactcctggggctgtggggacggcggacggctgggccatggggacactgtgcctttggaggagcctaaggtgatctccgccttctctggaaagcaggccgggaagcacgtggtgcacatcgcttgcgggagcacttacagtgcggccatcactgccgagggggagctgtacacctggggccgcgggaactacggccggctgggccatggctccagtgaggacgaggccattccgatgctggtagccgggcttaaaggactgaaggtcatcgatgtggcgtgtgggagtggggatgctcaaaccctggctgtcactgagaacgggcaagtgtggtcttggggagatggtgactatgggaaattgggcagaggtggtagtgatggctgcaaaaccccaaagctgattgaaaagcttcaagacttggatgtggtcaaagtccgctgtggaagtcagttttccattgctttgacgaaagatggccaagtttattcatggggaaaaggtgacaaccagagacttggacatggaacagaggaacatgttcgttatccaaaactcttagaaggcttgcaagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccagagctttgcttggtcatcatgttctgagtggtccattggcctccgtgtcccttttgtggtggacatctgctcaatgacttttgagcagctagatctcctgcttcggcaggtgagtgaggggatggatggctccgcggactggcccccgccccaggagaaagagtgtgtggccgtggcaacgctgaatcttctacgacttcagttgcatgctgccattagtcaccaggttgacccggaattccttggtttaggtctgggcagcatcctcctgaacagcctgaagcagacggtggtgaccctggccagcagtgcgggcgtgctgagcaccgtgcagtcggccgcccaggccgtgctgcagagtggctggtccgtgctgctgcccaccgcggaggagcgggcccgggcactctctgctctcctgccctgcgcagtttcaggcaatgaagtgaacataagtccaggtcgtcgattcatgattgatcttctggtgggcagcttgatggctgatggagggttggagtcagccttacacgcagccattactgcagagatccaggatattgaagccaaaaaagaagcacagaaggaaaaagaaattgatgaacaggaagcgaatgcctcaacatttcatagaagcaggactccactggataaagaccttattaatacggggatctgtgagtcttctggcaaacagtgtttgcctctggttcagctcatacaacagcttcttagaaacatcgcttctcagactgtagccagattgaaagatgttgcccgtcggatttcatcatgtctggactttgagcaacacagtcgtgaaagatctgcttcattggattggttactgcgtttccaacgtttgcttattagtaaactttatccaggagaaagtattggtcagacctcagatatttctagtccagagctaatgggtgttggttccttgctgaagaagtacacagccctcctgtgcacgcacattggagatatactgcctgtggccgccagcattgcttctaccagctggcggcacttcgcggaggtggcttacattgtggaaggggactttactggtgttctccttccagaactagtagtttctatagtgcttctgctcagtaaaaatgctgatctcatgcaagaggctggagctgtacctctgctgggtggcctgttggaacatctggatcggttcaaccatctggcaccaggaaaggaacgggatgatcatgaagagttagcctggcctggcataatggagtcattttttacaggtcagaactgtagaaataatgaggaagtgacacttatacgcaaagctgatttggagaaccataataaagatggaggcttctggactgtgattgacgggaaggtgtatgatataaaggacttccagacacagtcgttaacaggaaatagtattcttgctcagtttgcaggggaagacccagtggtagctttggaagctgctttgcagtttgaagacacccgggaatccatgcacgcgttttgtgttggccagtatttggagcctgaccaagaaatcgtcaccataccagatctggggagtctctcttcacctctgatagacacagagaggaatctgggcctgcttctcggattacacgcttcgtatttggcaatgagcacaccgctgtctcctgtcgagattgaatgtgccaaatggcttcagtcatccatcttctctggaggcctgcagaccagccagatccactacaggtacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgttgttatgttgcctcttaaaacatgaagatttaggtcatgtggcattatctttagttcatgcaggtgcacttggtattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcgaacgtttgagattcctctttaatgaattgagacctgctgtttgtaatgacctctctataatgtctaagtttaaattgttaagttctttgccccgttggaggaggatagctcaaaagataattcgagaacgaaggaaaaagagagttcctaagaagccagaatctatggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacaggtgttcacaaatacaagtggttgaagcagaatgtgcagggtctttatccgcagtctccactcctcagtacaattgctgaatttgcccttaaagaagagccagtggatgtggaaaaaatgagaaagtgcctactaaaacagttggagagagcagaggttcgcctggaagggatagatacaattttaaaactggcgagcaagaatttcttacttccatctgtgcagtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgtacagaacattcgaaatgttttgatggatgccagtgccacatttaaagagcttggtatccagccggttcccctccaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggatgggcctcctccaggcctaggccgcgtgattggtgagctgggagaggacggatggataagagtccagtgggacacaggcagcaccaactcctacaggatggggaaagaaggaaaatacgacctcaagctggcagagctgccggctgctgcacagccctcagcagaggattcggacacagaggatgactctgaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatcttctccaaacaggctggtgtacagggagcaacaccggagctggtgcacgctggggtttgtgcggagcatcgctctcacgccgcaggtatgcggcgccctcagctccccgcagtggatcacgctgctcatgaaggtcgtggaagggcacgcacccttcactgccacctcgctgcagaggcagatcttagctgtgcatttgttgcaagcagtccttccatcatgggacaagaccgaaagggcgagggacatgaaatgcctcgtggagaagctgtttgacttcttgggaagcttgctcactacctgctcctctgacgtgccattactcagagagtccacgctgaggcggcgcagggtgcgcccgcaggcctcgctgactgccacccacagcagcacactggcggaggaggtggtggcactgctgcgcacgctgcactccctgactcagtggaatgggctcatcaacaagtacatcaactcccagctccgctccatcacccacagctttgtgggaaggccttccgaaggggcccagttagaggactacttccccgactccgagaaccctgaagtggggggcctcatggcagtcctggctgtgattggaggcatcgatggtcgcctgcgcctgggcggtcaagttatgcacgatgagtttggagaaggcactgtgactcgcatcaccccaaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggtgccagcagttgaagctatacatcctgaaagcaggtcgggcgctgctctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggctgctgcactggccgtttgccagtgcttggctgtggagtccactcacccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcatccagcttgcctggtgtggaagccttggtcgggtggctgctggaccactccgacatacaggtcacggagctctcagatgcagacacggtgtccgacgagtattctgacgaggaggtggtggaggacgtggatgatgccgcctactccatgtctactggtgctgttgtgacggagagccagacgtacaaaaaacgagctgatttcttgagtaatgatgattatgctgtatatgtgagagagaatattcaggtgggaatgatggttagatgctgccgagcgtatgaagaagtgtgcgaaggtgatgttggcaaagtcatcaagctggacagagatggattgcatgatctcaatgtgcagtgtgactggcagcagaaagggggcacctactgggttaggtacattcatgtggaacttataggctatcctccaccaagttcttcttctcacatcaagattggtgataaagtgcgggtcaaagcctctgtcaccacaccaaaatacaaatggggatctgtgactcatcagagtgtgggggttgtgaaagctttcagtgccaatggaaaagatatcattgtcgactttccccagcagtctcactggactgggttgctatcagaaatggagttggtacccagtattcatcctggggttacgtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactacacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagacccgttaggtgcttcctacttaggcgtgccctcagatgctgattcttctgctgccagtaataaaataagtggtgcaagtaattctaagccaaatcgcccttctcttgccaagattctcttgtcattggatggaaatctggccaaacagcaggccttatcgcatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagctgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactagtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaatcatctataaataaaacatctgacat

SEQ ID NO: 285433 - DNA, 516 bp, Homo sapiens
agcggcgccggctgagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacaggtattgagtgttggtagatatgagagtccagtgtttagagctgtgttgcgtggccgggcgcagtggctcacgcctgtaatcccggcagtttgggaggccgaggcgggtggatgccctgaggtcaggagttggagaccagcctgaccaacatggtgaaaccccgtctctactaaaaatacaaaattagccaggcgtggtggtgtatgcctgtaatcccagccactcgggaggctgaggcaggagaatcgcttgaacccgggaggtggaggttgcaatgggtcaagatcatgccattgcactccagcctggacaatgagagcaaaactgtttc

SEQ ID NO: 285434 - DNA, 815 bp, Homo sapiens
  misc_feature (785)..(785): n is a, c, g, or t
agcggcgccggctgagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggagagctccctcctagaaaagtagagacagggtttcaccgtgttagccaggatggtctcgagctcctgacctcgtgatccgcccgcctcagcctcccaaagtgctgggattataggcgtgagccaccgtgcctgatgatagtgtcgaaccaagtggaacaaagaaagaagatctgaatgacaaagagaaaaaagatgaagaagaaactcctgcacctatatatagggccaagtcaattctggacagctgggtatggggcaagcaaccagatgtgaatgaactgaaggagtgtctttctgtgctggttaaagagcagcaggccctggccgtccagtcagccaccaccaccctctcagccctgcgactcaagcagaggctggtgatcttggagcgctatttcattgccttgaatagaaccgtttttcaggagaatgtcaaagttaagtggaaaagcagcggtatttctctgcctcctgtggacaaaaaaagttcccggctggggcaangtgtggaagggctccccaaggggattccgg

SEQ ID NO: 285435 - DNA, 415 bp, Homo sapiens
atccacttgtgatcctgtcacttgaagaaaaccattggtcggattttggtacacaccctttcatagtattgattttatgtagtatctgcaccctctgctgctgactggttgtatgttccgtgtgtgtcgtctgcagttcccggcctgcgggcaaaggtgtggaggggctcgccagagtgggatcccgagcggcgctgtcttttgcctttgccttcctgcgcagggcctggcgatcaggtacggtccctggtgtggcgcgttgttctgcttccctaatacatcaacagactgggtttcgaactcggttcagccaccatgtgccctttggctgatcccatgtgctctctgtgcctcagtttccttgcttgtgagatgagaggctgcagaggctgtttggcttttcacatctgtgctt
